United States Patent
Hanna et al.

(10) Patent No.: US 11,920,164 B2
(45) Date of Patent: Mar. 5, 2024

(54) MEDIA FOR CULTURING NAIVE HUMAN PLURIPOTENT STEM CELLS

(71) Applicant: Yeda Research and Development Co. Ltd., Rehovot (IL)

(72) Inventors: Yaqub Hanna, Tel-Aviv (IL); Noa Novershtern, Rehovot (IL); Yoach Rais, Rehovot (IL)

(73) Assignee: Yeda Research and Development Co. Ltd., Rehovot (IL)

( * ) Notice: Subject to any disclaimer, the term of this patent is extended or adjusted under 35 U.S.C. 154(b) by 0 days.

(21) Appl. No.: 15/500,163

(22) PCT Filed: Jul. 30, 2015

(86) PCT No.: PCT/IL2015/050785
§ 371 (c)(1),
(2) Date: Jan. 30, 2017

(87) PCT Pub. No.: WO2016/016894
PCT Pub. Date: Feb. 4, 2016

(65) Prior Publication Data
US 2017/0275593 A1 Sep. 28, 2017

Related U.S. Application Data

(60) Provisional application No. 62/167,469, filed on May 28, 2015, provisional application No. 62/030,792, filed on Jul. 30, 2014.

(51) Int. Cl.
*C12N 5/00* (2006.01)
*C12N 5/0735* (2010.01)
*C12N 5/074* (2010.01)

(52) U.S. Cl.
CPC ......... *C12N 5/0696* (2013.01); *C12N 5/0037* (2013.01); *C12N 5/0606* (2013.01); *C12N 2500/38* (2013.01); *C12N 2500/90* (2013.01); *C12N 2501/01* (2013.01); *C12N 2501/115* (2013.01); *C12N 2501/125* (2013.01); *C12N 2501/15* (2013.01); *C12N 2501/155* (2013.01); *C12N 2501/16* (2013.01); *C12N 2501/235* (2013.01); *C12N 2501/415* (2013.01); *C12N 2501/50* (2013.01); *C12N 2501/60* (2013.01); *C12N 2501/71* (2013.01); *C12N 2501/72* (2013.01); *C12N 2501/727* (2013.01); *C12N 2501/73* (2013.01); *C12N 2501/999* (2013.01); *C12N 2506/00* (2013.01)

(58) Field of Classification Search
None
See application file for complete search history.

(56) References Cited

U.S. PATENT DOCUMENTS

| 6,090,622 A | 7/2000 | Gearhart et al. | |
|---|---|---|---|
| 2006/0194315 A1* | 8/2006 | Condie | C12N 5/0606 435/366 |
| 2011/0076678 A1 | 3/2011 | Jaenisch et al. | |
| 2013/0273649 A1* | 10/2013 | Wu | C12N 5/0606 435/349 |
| 2014/0315301 A1* | 10/2014 | Hanna | C12N 5/0696 435/377 |
| 2016/0257928 A1* | 9/2016 | Nakauchi | C12N 5/0606 |
| 2021/0253998 A1 | 8/2021 | Hanna et al. | |

FOREIGN PATENT DOCUMENTS

| CN | 102317442 | 1/2012 | |
|---|---|---|---|
| GB | 2436737 | 10/2007 | |
| WO | WO 98/43679 | 10/1998 | |
| WO | WO 2009/101084 | 8/2009 | |
| WO | WO 2010/077955 | 7/2010 | |
| WO | WO-2010077955 A1 * | 7/2010 | ........... C12N 5/0606 |
| WO | WO 2014/174470 | 10/2014 | |
| WO | WO 2016/016894 | 2/2016 | |
| WO | WO 2016/079146 | 5/2016 | |

OTHER PUBLICATIONS

Hao et al Dev. Biol., 290, 81-91 (Year: 2006).*
Hao et al Dev. Biol., 290, 81-91 (Year: 2006).*
Hanna et al PNAS, vol. 107, pp. 9222-9227 (Year: 2010).*
Shimizu et al Stem Cells, 30, 1394-1404 (Year: 2012).*
Huang et al Cell Research 19:1127-1138 (Year: 2009).*
Rajendran et al J. Biol. Chem. 288, 24351-24362, (Year: 2013).*
Dutta et al Stem Cells 29, 618-628 (Year: 2010).*
Bendall et al Nature, 448, 1015-1023 (Year: 2007).*
Kim et al Nat Commun. 4: 2403, pp. 1-23 (Year: 2013).*
Gafni et al Nature, 12;504(7479):282-6 (Year: 2013).*
Hanna PNAS, 107, 9222-9227 (Year: 2010).*
Gafni et al Nature, 282-286 (Year: 2013).*
Murayama et al., Stem Cell Reports, 4, 103-113, (Year: 2014).*
Kim et al Nat Commun.; 4: 2403, 1-11 (Year: 2013).*
Bayerl et al. Cell Stem Cell 28, 1549-1565 (Year: 2021).*
Declaration Yaqub Hanna Under 37 CFR 1.132 dated Jan. 23, 2017 in The U.S. Patent and Trademark Office Re. U.S. Appl. No. 14/259,997.
Official Action dated May 18, 2018 From the US Patent and Trademark Office Re. U.S. Appl. No. 14/259,997. (20 pages).
Daheron et al. "LIF/STAT3 Signaling Fails to Maintain Self-Renewal of Human Embryonic Stem Cells", Stem Cells 22(5): 770-778, Sep. 2004.
Hanna "Curriculum Vitae for Jacob H. Hanna," 18 pages, Apr. 2017.
Humphrey et al. "Maintenance of Pluripotency in Human Embryonic Stem Cells is STAT3 Independent", Stem Cells, 22(4): 522-530, Jul. 2004.

(Continued)

*Primary Examiner* — Anoop K Singh

(57) ABSTRACT

A culture medium is disclosed which comprises STAT3 activator, an ERK1/2 inhibitor and an Axin stabilizer, and optionally also a PKC inhibitor. Cell cultures comprising same and uses thereof are also disclosed.

1 Claim, 28 Drawing Sheets
(28 of 28 Drawing Sheet(s) Filed in Color)
Specification includes a Sequence Listing.

(56) References Cited

OTHER PUBLICATIONS

Kee et al. "Human DAZL, DAZ and BOULE Genes Modulate Primordial Germ Cell and Haploid Gamete Formation", Nature, 462(7270): 222-225, Nov. 12, 2009.
Liu et al. "Generation of Induced Pluripotent Stem Cells from Adult Rhesus Monkey Fibroblasts", Cell Stem Cell, 3(6), 587-590, Dec. 4, 2008.
Mitalipov et al. "Isolation and Characterization of Novel Rhesus Monkey Embryonic Stem Cell Lines", Stem Cells, 24(10): 2177-2186, Oct. 2006.
Silva et al. "X-chromosome Inactivation and Epigenetic Fluidity in Human Embryonic Stem Cells", Proceedings of the National Academy of Sciences 105(12): 4820-4825, Mar. 25, 2008.
Thomson et al. "Embryonic Stem Cell Lines Derived from Human Blastocysts", Science, 282: 1145-1147, Nov. 6, 1998.
Thomson et al. "Isolation of a Primate Embryonic Stem Cell Line," Proceedings of the National Academy of Sciences of the United States of America, 92: 7844-7848, 1995.
Thomson et al. "Pluripotent Cell Lines Derived from Common Marmoset (*Callithrix jacchus*) Blastocysts," Biology of Reproduction 55: 254-259, 1996.
Verfaillie et al. "Stem Cells: Hype and Reality", American Society of Hematology Education Program Book, 2002(1): 369-391, 2002.
Xu et al. "NANOG is a Direct Target of TGFbeta/Activin-Mediated SMAD Signaling in Human ESCs", Cell Stem Cell 3(2): 196-206, Aug. 7, 2008.
Advisory Action Before the Filing of An Appeal Brief dated Mar. 1, 2018 From the US Patent and Trademark Office Re. U.S. Appl. No. 14/259,997. (8 pages).
International Preliminary Report on Patentability dated Feb. 9, 2017 From the International Bureau of WIPO Re. Application No. PCT/IL2015/050785. (11 Pages).
Communication Pursuant to Article 94(3) EPC dated Oct. 26, 2017 From the European Patent Office Re. Application No. 14727237.1. (4 Pages).
Communication Pursuant to Article 94(3) EPC dated Jul. 24, 2018 From the European Patent Office Re. Application No. 14727237.1. (4 Pages).
Notification of Office Action and Search Report dated Apr. 17, 2018 From the State Intellectual Property Office of the People's Republic of China Re. Application No. 201480035892.7 and Its Translation Into English. (38 Pages).
Bendall et al. "IGF and FGF Cooperatively Establish the Regulatory Stem Cell Niche of Pluripotent Human Cells In Vitro", Nature, 448(7157): 1015-1023, Aug. 30, 2007.
Cerdan et al. "Novel Roles for Notch, Wnt and Hedgehog in Hematopoiesis Derived From Human Pluripotent Stem Cells", The International Journal of Developmental Biology, 54(6-7): 955-964, Published Online Mar. 15, 2010.
Dutta et al. "Self-Renewal Versus Lineage Commitment of Embryonic Stem Cells: Protein Kinase C Signaling Shifts the Balance", Stem Cells, 29(4): 618-628, Published Online Feb. 3, 2011.
Gauthaman et al. "Effect of ROCK Inhibitor Y-27632 on Normal and Variant Human Embryonic Stem Cells (hESCs) In Vitro: Its Benefits in hESC Expansion", Stem Cell Reviews and Reports, 6(1): 86-95, Published Online Dec. 15, 2009.
Katoh "Network of WNT and Other Reguatlory Signaling Cascades in Pluripotent Stem Cells and Cancer Stem Cells", Current Pharmaceutical Biotechnology, 12(2): 160-170, Feb. 1, 2011.
Ludwig et al. "Feeder-Independent Culture of Human Embryonic Stem Cells", Nature Methods, 3(8): 637-646, Aug. 2006.
Song et al. "Formation of Mouse Chimeras From Early Embryonic Pluripotent Stem Cell", Acta Genetica Sinica, 20(6): 499-503, 1993. English Abstract.
Xu et al. "C-Jun NH2-Terminal Kinase is Required for Lineage-Specific Differentiation but Not Stem Cell Self-Renewal", Molecular and Cellular Biology, 3096): 1329-1340, May 30, 2010.
Zhou et al. "Two Vital Transcriptional Factors Oct-4 and Nanog to Keep the Pluripotency and Self-Renewal of Stem Cells and Related Regulation Network", Hereditas, 30(5): 529-536, May 2008. English Abstract.
Advisory Action Before the Filing of an Appeal Brief dated Jul. 23, 2015 From the US Patent and Trademark Office Re. U.S. Appl. No. 14/259,997.
Applicant-Initiated Interview Summary dated Jan. 11, 2017 From the US Patent and Trademark Office Re. U.S. Appl. No. 14/259,997. (3 pages).
Communication Pursuant to Article 94(3) EPC dated Oct. 25, 2016 From the European Patent Office Re. Application No. 14727237.1. (5 Pages).
Communication Relating to the Results of the Partial International Search dated Nov. 11, 2015 From the International Searching Authority Re. Application No. PCT/IL2015/050785.
Communication Relating to the Results of the Partial International Search dated Jul. 30, 2014 From the International Searching Authority Re. Application No. PCT/IB2014/060954.
International Preliminary Report on Patentability dated Nov. 5, 2015 From the International Bureau of WIPO Re. Application No. PCT/IB2014/060954.
International Search Report and the Written Opinion dated Oct. 7, 2014 From the International Searching Authority Re. Application No. PCT/IB2014/060954.
International Search Report and the Written Opinion dated Jan. 12, 2016 From the International Searching Authority Re. Application No. PCT/IL2015/050785.
Office Action dated Apr. 13, 2016 From the Israel Patent Office Re. Application No. 241930.
Official Action dated Feb. 1, 2016 From the US Patent and Trademark Office Re. U.S. Appl. No. 14/259,997.
Official Action dated May 5, 2015 From the US Patent and Trademark Office Re. U.S. Appl. No. 14/259,997.
Official Action dated Sep. 16, 2016 From the US Patent and Trademark Office Re. U.S. Appl. No. 14/259,997.
Official Action dated Sep. 26, 2014 From the US Patent and Trademark Office Re. U.S. Appl. No. 14/259,997.
Ahn et al. "Production of Human CD59-Transgenic Pigs by Embryonic Germ Cell Nuclear Transfer", Biochemical and Biophysical Research Communications, XP027356570, 400(4): 667-672, Available Online Sep. 8, 2010.
Ang et al. "Wdr5 Mediates Self-Renewal and Reprogramming Via the Embryonic Stem Cell Core Transcriptional Network", Cell, 145: 183-197, Apr. 15, 2011.
Bermejo-Alvarez et al. "Solving the 'X' in Embryos and Stem Cells", Stem Cells and Development, XP055128368, 21(8): 1215-1224, May 20, 2012.
Claveria et al. "Myc-Driven Endogenous Cell Competition in the Early Mammalian Embryo", Nature, 500(7460): 39-44, Aug. 1, 2013.
De Los Angeles et al. "Accessing Naive Human Pluripotency", Current Opinion in Genetics & Development, XP028493568, 22(3): 272-282, Mar. 29, 2012.
De Vooght et al. "Management of Gene Promoter Mutations in Molecular Diagnostics", Clinical Chemistry, 55(4): 698-708, 2009.
Dejosez et al. "Safeguards for Cell Cooperation in Mouse Embryogenesis Shown by Genome-Wide Cheater Screen", Science, 341: 1511-1514, Sep. 27, 2013.
Eguizabal et al. "Generation of Primordial Germ Cells From Pluripotent Stem Cells", Differentiation, XP026601254, 78(2-3): 116-123, Sep. 1, 2009. Fig.1, 2.
Ezashi et al. "Low O2 Tensions and the Prevention of Differentiation of hES Cells", Proc. Natl. Acad. Sci. USA, PNAS, 102(13): 4783-4788, Mar. 29, 2005.
Gafni et al. "Derivation of Novel Human Ground State Naive Pluripotent Stem Cells", Nature, XP055128176, 504(7479): 282-286, Dec. 12, 2013.
Gerstein et al. "What is a Gene, Post-ENCODE? History and Updated Definition", Genome Research, 17: 669-681, 2007.
Gnanapragasam et al. "P66Alpha-MBD2 Coiled-Coil Interaction and Recruitment of Mi-2 are Critical for Globin Gene Silencing by

(56) References Cited

OTHER PUBLICATIONS the MBD2-NuRD Complex", Proc. Natl. Acad. Sci. USA, PNAS, 108(18): 7487-7492, May 3, 2011.
Hanna "The STATs on Naive iPSC Reprogramming", Cell Stem Cell, 7: 274-276, Sep. 3, 2010.
Hanna et al. "Direct Cell Reprogramming is a Stochastic Process Amenable to Acceleration", Nature, 462(7273): 595-601, Dec. 3, 2009.
Hanna et al. "Human Embryonic Stem Cells With Biological and Epigenetic Characteristics Similar to Those of Mouse ESCs", Proc. Natl. Acad. Sci. USA, PNAS, XP055054545, 107(20): 9222-9227, May 18, 2010. p. 9224-9225.
Hanna et al. "Metastable Pluripotent States in NOD Mouse Derived ES Cells", Cell Stem Cell, 4(6): 513-524, Jun. 5, 2009.
Hanna et al. "Pluripotency and Cellular Reprogramming: Facts, Hypotheses, Unresolved Issues", Cell, XP055074652, 143(4): 508-525, Nov. 12, 2010.
Hanna et al. "Supporting Information", Proc. Nat. Acad. Sci., PNAS, USA, vol. 107: pp. 1-10, 2010.
Hao et al. "Wnt/Beta-Catenin Pathway Up-Regulates Stat3 and Converges on LIF to Prevent Differentiation of Mouse Embryonic Stem Cells", Developmental Biology, XP027332417, 290(1): 81-91, Available Online Dec. 5, 2005. Abstract, p. 86, Fig.2, p. 89, 1-h Col., Para 1, Fig.5.
Hayashi et al. "Reconstitution of the Mouse Germ Cell Specification Pathway in Culture by Pluripotent Stem Cells", Cell, XP028383021, 146(4): 519-532, Aug. 19, 2011. p. 531, Fig.6.
Huangfu et al. "Induction of Pluripotent Stem Cells From Primary Human Fibroblasts With Only Oct4 and Sox2", Nature Biotechnology, 26(11): 1269-1275, Advance Online Publication Oct. 12, 2008.
Kaji et al. "The NuRD Component Mbd3 is Required for Pluripotency of Embryonic Stem Cells", Nature Cell Biology, 8(3): 285-292, Published Online Feb. 5, 2006.
Kawakami et al. "XIST Unmethylated DNA Fragments in Male-Derived Plasma as a Tumour Marker for Testicular Cancer", The Lancet, 363: 40-42, Jan. 3, 2004.
Kim et al. "Modulation of Beta-Catenin Function Maintains Mouse Epiblast Stem Cell and Human Embryonic Stem Cell Self-Renewal", Nature Communications, 4(2403): 1-11, Aug. 29, 2013.
Lai et al. "Cancer Biology and NuRD: A Multifaceted Chromatin Remodelling Complex", Nature Reviews Cancer, 11: 588-596, Aug. 2011.
Larsen et al. "The Chromatin-Remodeling Factor CHD4 Coordinates Signaling and Repair After DNA Damage", The Journal of Cell Biology, 190(3): 731-740, Aug. 30, 2010.
Lengner et al. "Derivation of Pre-X Inactivation Human Embryonic Stem Cells Under Physiological Oxygen Concentrations", Cell, XP055075377, 141(5): 872-883, May 1, 2010. Figs.2, 3.
Li et al. "Calcineurin-NFAT Signaling Critically Regulates Early Lineage Specification in Mouse Embryonic Stem Cells and Embryos", Cell Stem Cell, 8: 46-58, Jan. 7, 2011.
Library of Medicine "What is a Gene?", Genetics Home Reference, National Library of Medicine, Database [Online], 2 Pages, Apr. 28, 2015.
Lin et al. "Toward Directed Reprogramming Through Exogenous Factors", Current Opinion in Genetics & Development, XP055224607, 23(5): 519-525, Available Online Aug. 8, 2013. Abstract, p. 519, r-h Col., Para 4-p. 520, 1-h Col., Para 1, Fig.1.
Ludwig et al. "Derivation of Human Embryonic Stem Cells in Defined Conditions", Nature Biotechnology, 24(2): 185-187, Feb. 2006 and Supplementary Material.
Luo et al. "NuRD Blocks Reprogramming of Mouse Somatic Cells Into Pluripotent Stem Cells", Stem Cells, 31(7): 1278-1286, Epub Ahead of Print Mar. 26, 2013. Abstract, p. 1279, 1-h Col., Last Para, p. 1282, r-h Col., Last Para-p. 1283, 1-h Col., Para 1.
Mansour et al. "The H3K27 Demethylase Utx Regulates Somatic and Germ Cell Epigenetic Reprogramming", Nature, 488: 409413, Aug. 16, 2012.

Medvedev et al. "Epigenetics of Pluripotent Cells", Acta Naturae, XP055236451, 4(4): 28-46, Oct. 2012. Abstract, p. 34, r-h Col., Para 2, p. 40, 1-h Col., Para 1.
Okamoto et al. "Eutherian Mammals Use Diverse Strategies to Initiate X-Chromosome Inactivation During Development", Nature, 472: 370-374, Apr. 21, 2011.
Onder et al. "Chromatin-Modifying Enzymes as Modulators of Reprogramming", Nature, 483: 598-602, Mar. 29, 2012.
Orkin et al. "Chromatin Connections to Pluripotency and Cellular Reprogramming", Cell, 145: 835-850, Jun. 10, 2011.
Park et al. "Derivation of Primordial Germ Cells From Human Embryonic and Induced Pluripotent Stem Cells is Significantly Improved by Coculture With Human Fetal Gonadal Cells", Stem Cells, XP002730074, 27(4): 783-795, 2009.
Polo et al. "A Molecular Roadmap of Reprogramming Somatic Cells Into iPS Cells", Cell, 151: 1617-1632, Dec. 21, 2012.
Shimizu et al. "Dual Inhibition of Src and GSK3 Maintains Mouse Embryonic Stem Cells, Whose Differentiation is Mechanically Regulated by Scr Signalling", Stem Cells, 30: 1394-1404, 2012.
Takahashi et al. "Induction of Pluripotent Stem Cells From Mouse Embryonic and Adult Fibroblast Cultures by Defined Factors", Cell, 126: 663-676, Aug. 25, 2006.
Tesar et al. "New Cell Lines From Mouse Epiblast Share Defining Features With Human Embryonic Stem Cells", Nature, 448: 196-199, Jul. 12, 2007.
ThermoFisher "Technical Resources, 12634, Advanced D-MEM/F-12", ThermoFisher Scientific, 3 Pages, 2016.
Tomoda et al. "Derivation Conditions Impact X-Inactivation Status in Female Human Induced Pluripotent Stem Cells", Cell Stem Cell, 11: 91-99, Jul. 6, 2012.
U.S. National Library of Medicine "Genetics Home Reference: Your Guide to Understanding Genetic Conditions", U.S. National Library of Medicine, Handbook, 1 P., Apr. 20, 2015.
Van der Jeught et al. "Application of Small Molecules Favoring Naive Pluripotency During Human Embryonic Stem Cell Derivation", Cellular Reprogramming, XP055224755, 17(3): 170-180, Jun. 2015. Abstract, p. 174, r-h Col., Para 3.
Vasques et al. "XIST Repression in the Absence of DNMT1 and DNMT3B", DNA Research, 12: 373-378, Published Online Jan. 11, 2006.
Ware et al. "Derivation of Naive Human Embryonic Stem Cells", Proc. Natl. Acad. Sci. USA, PNAS, XP002727154, 111(12): 4484-4489, Mar. 25, 2014.
Xu et al. "Proliferation Rate of Somatic Cells Affects Reprogramming Efficiency", The Journal of Biological Chemistry, 288(14): 9767-9778, Apr. 5, 2013.
Ying et al. "Induction of Primordial Germ Cells From Pluripotent Epiblast", Reviews in Stem and Progenitor Cells, The Scientific World Journal, XP009097195, 2: 801-810, Mar. 26, 2002.
Yoshida et al. "Hypoxia Enhances the Generation of Induced Pluripotent Stem Cells", Cell Stem Cell, 5: 237-241, Sep. 4, 2009.
Zhang et al. "Small Molecules, Big Roles—The Chemical Manipulation of Stem Cell Fate and Somatic Cell Reprogramming", Journal of Cell Science, XP055112620, 125(23): 5609-5620, Dec. 1, 2012.
Zhou et al. "Generation of Induced Pluripotent Stem Cells Using Recombinant Proteins", Cell Stem Cell, 4(5): 381-384, May 8, 2009.
Zhu et al. "Mbd3, A Component of NuRD/Mi-2 Complex, Helps Maintain Pluripotency of Mouse Embryonic Stem Cells by Repressing Trophectoderm Differentiation", PLoS One, 4(11): e7684-1-e7684-11, Nov. 3, 2009.
Notice of Reasons for Refusal dated Mar. 27, 2018 From the Japan Patent Office Re. Application No. 2016-509588 and Its Translation Into English. (7 Pages).
Official Action dated May 10, 2017 From the US Patent and Trademark Office Re. U.S. Appl. No. 14/259,997. (18 pages).
Huang et al. "More Synergetic Cooperation of Yamanaka Factors in Induced Pluripotent Stem Cells Than in Embryonic Stem Cells", Cell Research, 19: 1127-1138, 2009.
Theunissen et al. "Systematic Identification of Culture Conditions for Induction and Maintenance of Naive Human Pluripotency", Cell, 15: 471-487, Oct. 2, 2014.

(56) References Cited

OTHER PUBLICATIONS

Official Action dated Nov. 27, 2017 From the US Patent and Trademark Office Re. U.S. Appl. No. 14/259,997. (15 pages).
Betschinger et al. "Exit from Pluripotency is Gated by Intracellular Redistribution of the bHLH Transcription Factor Tfe", Cell, 153: 335-347, Apr. 11, 2013.
Tsuneyoshi et al. "Guards at the Gate to Embryonic Stem Cell Differentiation", Cell, 153: 281-283, Apr. 11, 2013.
Communication Pursuant to Article 94(3) EPC dated Jun. 5, 2019 From the European Patent Office Re. Application No. 15759548.9 (6 Pages).
Office Action dated Mar. 28, 2019 From the Israel Patent Office Re. Application No. 250340 and Its Translation Into English. (6 Pages).
Office Action dated May 23, 2019 From the Israel Patent Office Re. Application No. 241930 and Its Translation Into English. (7 Pages).
Takao et al. "Beta-Catenin Up-Regulates Nanog Expression Through Interaction With Oct-3/4 in Embryonic Stem Cells", Biochemical and Biophysical Research Communications, 353(3): 699-705, Available Online Dec. 20, 2006.
Communication Pursuant to Article 94(3) EPC dated Mar. 19, 2020 From the European Patent Office Re. Application No. 15759548.9 (5 Pages).
Final Official Action dated Apr. 1, 2020 from the US Patent and Trademark Office Re. U.S. Appl. No. 14/259,997. (12 pages).
Dutta "Signaling Pathways Dictating Pluripotency in Embryonic Stem Cells", The International Journal of Developmental Biology, XP055224613, 57(9-10): 667-675, Nov. 4, 2013.
Advisory Action dated Jul. 2, 2020 from the US Patent and Trademark Office Re. U.S. Appl. No. 14/259,997. (8 pages).
Notification of Office Action and Search Report dated Oct. 12, 2020 From the National Intellectual Property Administration of the People's Republic of China Re. Application No. 201580052710.1. (19 Pages).
Translation Dated Dec. 9, 2020 of Notification of Office Action and Search Report dated Oct. 12, 2020 From the National Intellectual Property Administration of the People's Republic of China Re. Application No. 201580052710.1. (25 Pages).
Dhanak et al. "Development and Classes of Epigenetic Drug for Cancer", Biochemical and Biophysical Research Communications, 455(1-2): 58-69, Published Online Jul. 10, 2014.
Gao et al. "The BMP Inhibitor Coco Reactivates Breast Cancer Cells at Lung Metastatic Sites", Cell, 150(4): 764-779, Aug. 17, 2012.
Johnson et al. "The Two Faces of Hippo: Targeting the Hippo Pathway for Regenerative Medicine and Cancer Treatment", Nature Reviews Drug Discovery, 13(1): 63-79, Published Online Dec. 13, 2013.
Vedadi et al. "A Chemical Probe Selectively Inhibits G9a and GLP Methyltransferase Activity in Cells", Nature Chemical Biology, 7(8): 566-574, Published Online Jul. 10, 2011.
Notification of Office Action and Search Report dated May 8, 2021 From the State Intellectual Property Office of the People's Republic of China Re. Application No. 201580052710.1 (13 Pages).
Translation Dated Jun. 10, 2021 of Notification of Office Action and Search Report dated May 8, 2021 From the State Intellectual Property Office of the People's Republic of China Re. Application No. 201580052710.1 (19 Pages).
Aulicino et al. "Temporal Perturbation of the Wnt Signaling Pathway in the Control of Cell Reprogramming is Modulated by TCF1", Stem Cell Reports 2(5):707-720, May 6, 2014.
Gafni et al. "Derivation of Novel Human Ground State Naive Pluripotent Stem Cells", Nature 504:282-286, Oct. 30, 2013.
Murayama et al. "Successful Reprogramming of Epiblast Stem Cells by Blocking Nuclear Localization of ?-Catenin", Stem Cell Reports 4(1):103-113, Jan. 13, 2015.
Decision of Rejection dated Apr. 8, 2022 From the State Intellectual Property Office of the People's Republic of China Re. Application No. 201580052710.1 totether with English Summary and Claims. (12 Pages).
English Translation Dated May 7, 2022 of Decision of Rejetion dated Apr. 8, 2022 From the State Intellectual Property Office of the People's Republic of China Re. Application No. 201580052710.1 totether with English Summary and Claims. (12 Pages).
Official Action dated Dec. 31, 2018 From the US Patent and Trademark Office Re. U.S. Appl. No. 14/259,997. (19 pages).
Official Action dated Aug. 22, 2019 From the US Patent and Trademark Office Re. U.S. Appl. No. 14/259,997. (24 pages).
Fang et al. "Generation of Naive Induced Pluripotent Stem Cells from Rhesus Monkey Fibroblasts", Cell Stem Cell, 15: 488-496, Oct. 2, 2014.
Restriction Official Action dated Apr. 14, 2023 from the US Patent and Trademark Office Re. U.S. Appl. No. 17/117,157. (6 pages).
Interview Summary dated Jun. 15, 2023 from the US Patent and Trademark Office Re. U.S. Appl. No. 17/117,157. (2 pages).

\* cited by examiner

FIG. 8

Condition 41: WIS-NHSM
LIF (20ng/ml)
ERK1/2i (PD0325901 1µM)
AXINs (IWR1 5µM)
PKCi (Go6983 2µM)

Condition 42: WIS-NHSM
LIF (20ng/ml)
ERK1/2i (PD0325901 1µM)
AXINs (IWR1 5µM)
PKCi (Go6983 2µM)
------
L-ascorbic acid (50µg/ml)

Condition 43: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)

Condition 44: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)

Condition 45: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)

Condition 46: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
SRCi (CGP77675 1.5µM)

Condition 47: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
P38i (BIRB796 1µM)

Condition 48: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 1µM)

Condition 49: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
SRCi (CGP77675 1.5µM)

Condition 50: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
RAFi (SB590885 0.5µM)

Condition 51: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
RAFi- SB590885 0.5µM

Condition 52: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 0.1µM)

Condition 53: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
SRCi (CGP77675 1.5µM)
RAFi (SB590885 0.5µM)

Condition 54: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
RAFi (SB590885 0.5µM)
SRCi (CGP77675 1.5µM)

Condition 55: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
RAFi- SB590885 0.5µM
P38i (BIRB796 0.1µM)

Condition 56: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 0.1µM)
SRCi (CGP77675 1.5µM)

Condition 57: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
SRCi (CGP77675 1.5µM)
RAFi (SB590885 0.5µM)
+BMPi (LDN-193189 0.2µM)

Condition 58: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
RAFi (SB590885 0.5µM)
SRCi (CGP77675 1.5µM)
+BMPi (LDN-193189 0.2µM)

Condition 59: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
RAFi- SB590885 0.5µM
P38i (BIRB796 0.1µM)
+BMPi (LDN-193189 0.2µM)

Condition 60: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 0.1µM)
SRCi (CGP77675 1.5µM)
+BMPi (LDN-193189 0.2µM)

FIG. 9

Condition 61: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
SRCi (CGP77675 1.5µM)+BMP4 (5ng/ml)

Condition 62: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
RAFi (SB590885 0.5µM)
SRCi (CGP77675 1.5µM)
+BMP4 (5ng/ml)

Condition 63: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
RAFi- SB590885 0.5µM
P38i (BIRB796 0.1µM)
+BMP4 (5ng/ml)

Condition 64: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 0.1µM)
SRCi (CGP77675 1.5µM)
+BMP4 (5ng/ml)

Condition 65: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
+BMP4 (5ng/ml)

Condition 66: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
+BMP4 (5ng/ml)

Condition 67: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
+BMP4 (5ng/ml)

Condition 68: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
P38i (BIRB796 0.1µM)
ROCKi (Y27632 2µM)
+BMP4 (5ng/ml)

Condition 69: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
+BMPi (LDN-193189 0.2µM)

Condition 70: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
+BMPi (LDN-193189 0.2µM)

Condition 71: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
SRCi (CGP77675 1.5µM)
+BMPi (LDN-193189 0.2µM)

Condition 72: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 0.1µM)
+BMPi (LDN-193189 0.2µM)

Condition 73: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
FGFRi (PD173074 0.1µM)

Condition 74: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
FGFRi (PD173074 0.1µM)

Condition 75: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
SRCi (CGP77675 1.5µM)
FGFRi (PD173074 0.1µM)

Condition 76: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 0.1µM)
FGFRi (PD173074 0.1µM)

Condition 77: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
SRCi (CGP77675 1.5µM)
FGFRi (PD173074 0.1µM)

Condition 78: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
ROCKi (Y27632 2µM)
P38i (BIRB796 0.1µM)
FGFRi (PD173074 0.1µM)

Condition 79: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
P38i (BIRB796 0.1µM)
FGFRi (PD173074 0.1µM)

Condition 80: WIS-NHSM
LIF (20ng/ml)
ERK1/2i (PD0325901 1µM)
AXINs (IWR1 5µM)
PKCi (Go6983 2µM)
------
GSK3βi (CHIR99021 1.5µM)
L-ascorbic acid (50µg/ml)
SRCi (CGP77675 1.5µM)
FGFRi (PD173074 0.1µM)
P38i (BIRB796 1µM)

FIG. 10

Condition 81: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
SRCi (CGP77675 1.5µM)
RAFi (SB590885 0.5µM)
+Activin A (20ng/ml)

Condition 82: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
RAFi (SB590885 0.5µM)
SRCi (CGP77675 1.5µM)
+Activin A (20ng/ml)

Condition 83: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
RAFi- SB590885 0.5µM
P38i (BIRB796 0.1µM)
+Activin A (20ng/ml)

Condition 84: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
P38i (BIRB796 0.1µM)
SRCi (CGP77675 1.5µM)
+Activin A (20ng/ml)

Condition 85: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
+Activin A (20ng/ml)

Condition 86: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
+Activin A (20ng/ml)

Condition 87: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
+Activin A (20ng/ml)

Condition 88: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
P38i (BIRB796 0.1µM)
ROCKi (Y27632 2µM)
+Activin A (20ng/ml)

Condition 89: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
TGFRi (SB431542 2µM)

Condition 90: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
TGFRi (SB431542 2µM)

Condition 91: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
SRCi (CGP77675 1.5µM)
TGFRi (SB431542 2µM)

Condition 92: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
P38i (BIRB796 0.1µM)
TGFRi (SB431542 2µM)

Condition 93: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
FGFRi (PD173074 0.1µM)
TGFRi (SB431542 2µM)

Condition 74: WIS-NHSM 9

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
TGFRi (SB431542 2µM)

Condition 95: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
FGFRi (PD173074 0.1µM)
TGFRi (SB431542 2µM)
SRCi (CGP77675 1.5µM)

Condition 96: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
P38i (BIRB796 0.1µM)
FGFRi (PD173074 0.1µM)
TGFRi (SB431542 2µM)

Condition 97: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
SRCi (CGP77675 1.5µM)
FGFRi (PD173074 0.1µM)
TGFRi (SB431542 2µM)

Condition 98: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
ROCKi (Y27632 2µM)
RAFi (SB590885 0.5µM)
FGFRi (PD173074 0.1µM)
TGFRi (SB431542 2µM)

Condition 99: WIS-NHSM

LIF (20ng/ml)
ERK1/2i (PD0325901 1µM)
AXINs (IWR1 5µM)
PKCi (Go6983 2µM)
-------
GSK3βi (CHIR99021 1.5µM)
L-ascorbic acid (50µg/ml)
SRCi (CGP77675 1.5µM)
FGFRi (PD173074 0.1µM)
TGFRi (SB431542 2µM)
P38i (BIRB796 0.1µM)

FIG. 11

Condition 100: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)

Condition 101: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)

Condition 102: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
P38i (BIRB796 2μM)

Condition 103: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
P38i (BIRB796 2μM)

Condition 104: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
P38i (BIRB796 2μM)
JNKi (SP600125 5μM)

Condition 105: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
P38i (BIRB796 2μM)
JNKi (SP600125 5μM)

Condition 106: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
P38i (BIRB796 2μM)
ERK5i (BIX02189 5μM)

Condition 107: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
P38i (BIRB796 2μM)
ERK5i (BIX02189 5μM)

Condition 108: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
TGFRi (SB431542 2μM)

Condition 109: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
TGFRi (SB431542 2μM)

Condition 110: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
FGFRi (PD173074 0.1μM)

Condition 111: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
FGFRi (PD173074 0.1μM)

Condition 112: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
P38i (BIRB796 2μM)
TGFRi (SB431542 2μM)

Condition 113: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
P38i (BIRB796 2μM)
TGFRi (SB431542 2μM)

Condition 114: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
P38i (BIRB796 2μM)
FGFRi (PD173074 0.1μM)

Condition 115: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
P38i (BIRB796 2μM)
FGFRi (PD173074 0.1μM)

Condition 116: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
LSDi (TCP 5μM)

Condition 117: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
LSDi (TCP 5μM)

Condition 118: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
P38i (BIRB796 2μM)
LSDi (TCP 5μM)

Condition 119: WIS-NHSM

LIF (20ng/ml)
ERK1/2i (PD0325901 1μM)
AXINs (IWR1 5μM)
PKCi (Go6983 4μM)

GSK3βi (CHIR99021 3μM)
L-ascorbic acid (50μg/ml)
ROCKi (Y27632 2μM)
P38i (BIRB796 2μM)
LSDi (TCP 5μM)

FIG. 12

Condition 120: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
Forskolin 5µM

Condition 121: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
ROCKi (Y27632 2µM)
Forskolin 5µM

Condition 122: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
P38i (BIRB796 2µM)
Forskolin 5µM

Condition 123: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
ROCKi (Y27632 2µM)
P38i (BIRB796 2µM)
Forskolin 5µM

Condition 124: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
DOT1Li (SGC0946 5µM)

Condition 125: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
ROCKi (Y27632 2µM)
DOT1Li (SGC0946 5µM)

Condition 126: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
P38i (BIRB796 2µM)

Condition 127: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
ROCKi (Y27632 2µM)
P38i (BIRB796 2µM)
DOT1Li (SGC0946 5µM)

Condition 128: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
P38i (BIRB796 2µM)
JNKi (SP600125 5µM)
ERK5i (BIX02189 5µM)

Condition 129: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
ROCKi (Y27632 2µM)
P38i (BIRB796 2µM)
JNKi (SP600125 5µM)
ERK5i (BIX02189 5µM)

Condition 130: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
ERK5i (BIX02189 5µM)

Condition 131: WIS-NHSM

LIF (20ng/ml)
ERK1/2i (PD0325901 1µM)
AXINs (IWR1 5µM)
PKCi (Go6983 4µM)

GSK3βi (CHIR99021 3µM)
L-ascorbic acid (50µg/ml)
ROCKi (Y27632 2µM)
ERK5i (BIX02189 5µM)

● Methylated ○ Unmethylated

● Methylated ○ Unmethylated
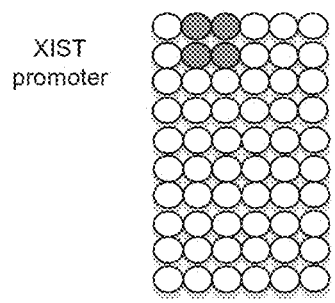
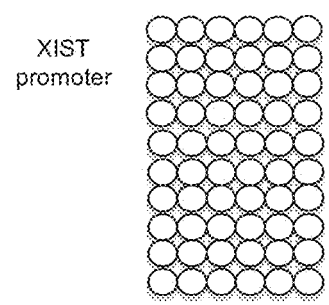
FIG. 17D
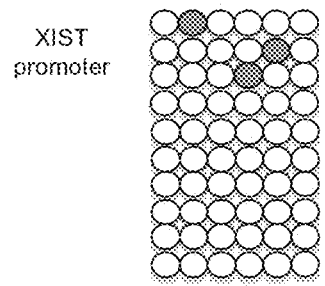
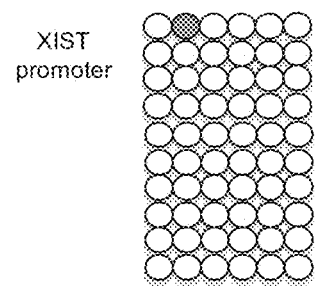
FIG. 17E
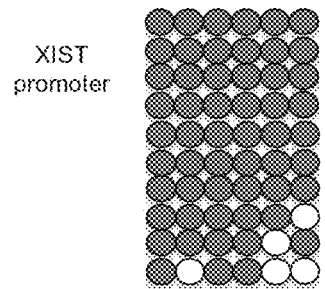
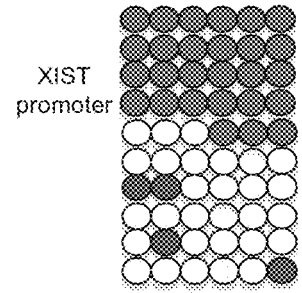
FIG. 17F

FIG. 19

Condition 132: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
G9ai BIX01294 0.5µM)
ROCKi (Y27632 2µM)

Condition 133: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
G9ai BIX01294 0.5µM)

Condition 134: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
SRCi (CGP77675 0.5µM)
P38i (BIRB796 0.25µM)
G9ai BIX01294 0.5µM)
ROCKi (Y27632 2µM)

Condition 135: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
ROCKi (Y27632 2µM)

Condition 136: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
G9ai BIX01294 0.5µM)
ROCKi (Y27632 2µM)

Condition 137: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
G9ai BIX01294 0.5µM)

Condition 138: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
SRCi (CGP77675 0.5µM)
G9ai BIX01294 0.5µM)
ROCKi (Y27632 2µM)

Condition 139: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
ROCKi (Y27632 2µM)

Condition 140: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
G9ai BIX01294 0.5µM)
ROCKi (Y27632 2µM)
RAFi (SB590885 0.25µM)

Condition 141: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
G9ai BIX01294 0.5µM)
RAFi (SB590885 0.25µM)

Condition 142: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
SRCi (CGP77675 0.5µM)
P38i (BIRB796 0.25µM)
G9ai BIX01294 0.5µM)
ROCKi (Y27632 2µM)
RAFi (SB590885 0.25µM)

Condition 143: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
ROCKi (Y27632 2µM)
RAFi (SB590885 0.25µM)

Condition 144: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
G9ai BIX01294 0.5µM)
ROCKi (Y27632 2µM)
SCF (20ng/ml)

Condition 145: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
G9ai BIX01294 0.5µM)
SCF (10ng/ml)

Condition 146: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
SRCi (CGP77675 0.5µM)
P38i (BIRB796 0.25µM)
G9ai BIX01294 0.5µM)
ROCKi (Y27632 2µM)
SCF (10ng/ml)

Condition 147: WIS-NHSM
LIF (20ng/ml)
ERK1/2i (PD0325901 1µM)
AXINs (IWR1 5µM)
PKCi (Go6983 2µM)
--------
JNKi (SP600125 5µM)
GSK3βi (CHIR99021 1.5µM)
L-ascorbic acid (50µg/ml)
SRCi (CGP77675 0.5µM)
P38i (BIRB796 0.25µM)
ROCKi (Y27632 2µM)
SCF (10ng/ml)

FIG. 23A
LIS38 WT:  ATGCTGTCCCCGGACGATATTGAACAATGGTTCACTGAAG (SEQ ID NO:134)
Crispr_C2: ATGCTGTCCCCGTGAGCCACCGTGCC-----------CACTGAAG (SEQ ID NO:135)
FIG. 23B
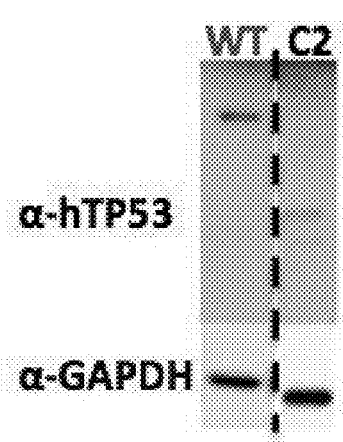
FIG. 23C
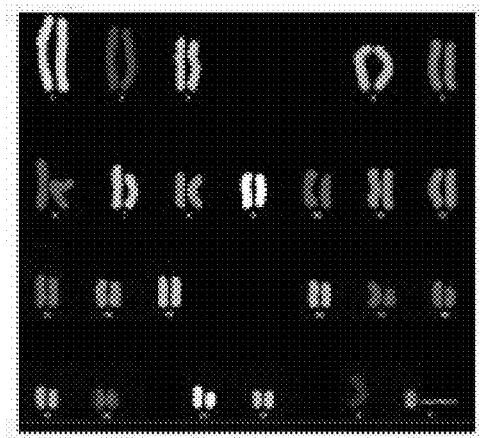
FIG. 23D
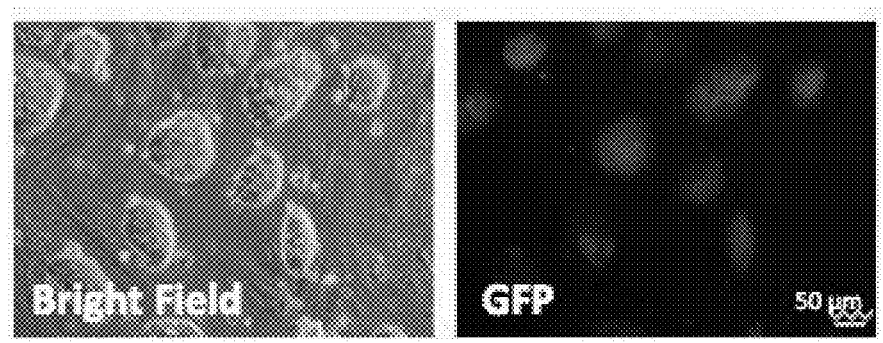

Primed WIBR3 hESC (In mTESR™ conditions)

Naive WIBR3 hESC condition #136

Naive WIBR3 hESC Naive Condition 138

Targeting strategy for making ESRRB-mCherry Knock-in reporter human PSC line

SB: EcoRI, 5' ext probe

SB: EcoRI, aCherry probe

Naive WIBR3 (no reporter allele) in condition #136

Naive WIBR3 (no reporter allele) in condition #136 - BIX01294

Naive WIBR3 ESRRB-mCherry knock-in in condition #136

Naive WIBR3 ESRRB-mCherry knock-in in condition #136 - BIX01294

Naive WIBR3 ESRRB-mCherry knock-in in condition #136 ++ ACTIVIN A

MEDIA FOR CULTURING NAIVE HUMAN PLURIPOTENT STEM CELLS

RELATED APPLICATIONS

This application is a National Phase of PCT Patent Application No. PCT/IL2015/050785, having International filing date of Jul. 30, 2015, which claims the benefit of priority under 35 USC § 119(e) of U.S. Provisional Patent Application Nos. 62/167,469, filed on May 28, 2015 and 62/030,792, filed on Jul. 30, 2014. The contents of the above applications are all incorporated by reference as if fully set forth herein in their entirety.

SEQUENCE LISTING STATEMENT

The ASCII file, entitled 68606SequenceListing.txt, created on Jan. 30, 2017, comprising 998,415 bytes, submitted concurrently with the filing of this application is incorporated herein by reference.

FIELD AND BACKGROUND OF THE INVENTION

The present invention, in some embodiments thereof relates to novel culture media which can be used to generate and expand pluripotent stem cells in general and more particularly naive pluripotent stem cells.

ESC-like cells, termed induced pluripotent (iPS) cells can be generated from somatic cells by ectopic expression of different transcription factors, originally Oct4, Sox2, Klf4 and c-Myc, that share all defining features with naive mouse ESCs. The reprogramming process typically requires extensive cell proliferation of a period of at least one week, after which a certain fraction of the cell progeny successfully converts into ES-like state in an unpredictable pattern and with different time latencies. Great progress has been achieved in identifying additional and alternative transcriptional factors and small molecules that can substitute some of the exogenous factor or boost reprogramming efficiency when combined with Oct4, Sox2, Klf4 and c-Myc (OSKM). A variety of enzymes and chromatin remodelers have been identified to cooperate with the reprogramming factors in facilitating the required early and late chromatin changes leading to authentic iPSC reprogramming in a fraction of donor cell progeny (e.g., Wdr5, Utx, Tet2).

Despite of these advances, the reprogramming efficiency of somatic cells remains low. Further, for each individual somatic epigenome challenged with the overexpression of reprogramming factors, the outcome is highly stochastic, and the majority of cells assume different levels of reprogramming.

Embryonic stem cells (ESCs) were first isolated from mouse embryos by explanting the inner cell mass (ICM) of developing embryos in vitro in the presence of the leukemia inhibitory factor (LIF) cytokine and mouse embryonic feeder (MEF) cells. Mouse ESCs recapitulate molecular signatures of the nascent ICM and are, therefore, termed "naive pluripotent cells". This includes expression of Oct4, Nanog and Klf pluripotency genes, lack of epiblast and somatic early lineage specific markers, and maintenance of a pre X-inactivation state with both X chromosomes active in female cells. Further, the cells retain a non-restricted developmental potential as they can robustly differentiate into all cell types in vitro and, upon injection into the mouse blastocyst, they efficiently contribute to the three germ layers and to the germ-line of chimeric animals. Finally, the high growth rate and open chromatin confirmation of mouse ES cells, has rendered these cells as one of the most valuable tools for mouse genetics by allowing efficient gene specific targeting via homologous recombination.

Recently, a dramatically different type of pluripotent cells, termed EpiSCs, were derived by explanting the post-implantation epiblast in growth conditions supplemented with FGF2 [also known as "basic fibroblast growth factor (bFGF)"] and Activin. Although EpiSCs are pluripotent, they have a restricted developmental potential in comparison to ESCs and therefore are termed as "primed pluripotent cells". EpiSCs are highly inefficient in generating animal chimeras, have already undergone X chromosome inactivation, and demonstrate heterogeneous expression of early lineage-commitment markers Whereas naive murine pluripotent cells can differentiate into a primed EpiSC-like state in vitro by promoting Activin and FGF2 signaling, EpiSCs can epigenetically revert back to ESC-like naive pluripotency by defined signaling stimuli.

Remarkably, ESCs derived from humans share several defining features with EpiSC cells, rather than with mouse ESCs. In contrast to mouse ESCs, the maintenance of human ES cells requires FGF2 and Activin A (rather than LIF/Stat3 signaling), they are highly sensitive to passaging as single cells, display heterogeneous expression of epiblast and lineage commitment markers, and utilize the proximal enhancer element to drive the expression of Oct4 in the post-implantation Epiblast (rather than the distal Oct4 enhancer active in the ICM). Thus, the molecular and biological similarities of human ESCs with mouse epiblast EpiSCs suggest that human ESCs correspond to the primed pluripotent state rather than the naive state of mouse ESCs and that this could be the underlying reason for the biological properties of conventional human ESCs that impede their use for disease related research This includes laborious culture conditions, low gene targeting efficiencies by homologous recombination and the dramatic heterogeneity in differentiation propensity among different human ESC and iPSC lines.

The fact that conventional/primed human ESCs are derived from the ICM has led to the mistaken belief that the primed state is the only or "default" state of pluripotency that can be isolated in humans. Mouse naive ESC cells can be derived from Non-obese diabetogenic (NOD) mice blastocysts only if additional signaling molecules or transcription factors are exogenously provided together with LIF cytokine (e.g. Naive NOD ESC and iPSCs could be propagated in PD0325901/CHIR99021/LIF or Kenopaullone/CHIR99021/LIF or constitutive expression of Klf4/Lif and c-Myc/LIF conditions). In the absence of these additional factors (or in LIF only conditions), the naive state, even if isolated from the mouse ICM, is masked by in vitro acquisition of pluripotent state that is nearly indistinguishable from EpiSC cells in a process that probably imitates in vivo differentiation during normal early development. These findings allowed the generation of fully pluripotent naive ES and iPS cells from previously considered "non-permissive' strains. Experiments in NOD mice have raised the question whether appropriate conditions that allow derivation of naive or mouse ESC-like stem cell in humans have not been devised yet and that stabilization of a naive human pluripotent state requires additional undefined factors (similar or different from those applied to NOD mouse and rat ESCs/iPSCs). Further support for the possibility that explanted blastocysts differentiate in vitro into a primed state was generated by close monitoring of X chromosome dynamics in human female ESC lines derived in vitro and demonstrated that the cells undergo X chromosome inactivation as a part of an in vitro adaptation process following this derivation, and this can be accelerated by high oxygen concentrations, and attenuated partially by addition of LIF or specific types of feeder cells that provide undefined signals. These results indicated that XaXa (X-active, X-active, based on absence of XIST bodies) naive cells might be present in the human ICM, and that in vitro captured conventional human ESCs poorly reflect their ICM counterparts.

These observations have raised the possibility that appropriate conditions may have not been devised to allow isolation of naive stem cells from a range of species that have yielded thus far primed or EpiSC-like cells, possibly including humans. Indeed in a follow-up work evidence was provided for the possibility to derive alternative human pluripotent cell states that more extensively share defining features with murine ESCs. As previously shown (Hanna et al., 2010b), a screening approach was taken that involved introducing reprogramming factors and/or small molecules that support the naive pluripotent state led to in vitro stabilization of a novel pluripotent cell state that shares several defining features with murine ESCs (Hanna et al., 2010b). The propagation in LIF cytokine and ERK1/2 inhibitor PD0325901 and GSK3b inhibitor CHIR99021 (abbreviated as 2i supplemented conditions—two small molecule inhibitors of ERK1/2 signaling and GSK3β to promote WNT signaling, abbreviated as "PD/CH" or "2i" conditions) together with over-expression of OCT4/KLF4 or KLF2/KLF4 induced conversion of conventional human ES and iPS cells to what was then mistakenly referred as human naive pluripotent state reminiscent of that of mouse ESCs (Hanna et al., 2010b). These previously described naive human ESCs were pluripotent by several available criteria including embryonic body differentiation and in vivo teratoma formation. Importantly, they were epigenetically and molecularly distinct from conventional "primed" human ESCs/iPSCs. "Naive" hPSCs generated by Hanna et al., 2010b exhibited XIST methylation on both X alleles, high single cell cloning efficiency and showed a gene expression pattern that resembled that of naive mouse ES cells (lack of MHC class I expression, and clustered with murine naive ESCs in cross-species unbiased gene clustering for 9773 expressed orthologue genes) (Hanna et al., 2010b). Nevertheless, a major limitations and unsolved questions remain that cast doubt on the true pluripotency of previously published/established lines and their stability. Only transgene dependent naive ESC/iPSCs could be maintained for over 18 passages. Forskolin enabled replacement of exogenous factors together with 2i/LIF, but only for no more than 19 passages and the cultures retained high differentiation propensity (Hanna et al., 2010b). XIST was completely methylated in the previously referred naive human ESC/iPSCs and the cells lacked any XIST transcription (Hanna et al., 2010b), which is inconsistent with in vivo results on human blastocysts that clearly show XIST transcription (without forming XIST bodies, i.e., XIST coated X chromosomes) (Okamoto et al., 2011). Collectively, these findings suggest that the isolated cells thus far do not reflect authentic features of human ICM, and retain a compromised pluripotency and enhanced propensity for differentiation. Substantial published data generated by many different groups highlight the rationale behind the concept that genetically unmodified pluripotent naive human stem cells have not been adequately isolated so far, and that the conditions allowing expansion of such cells and their molecular properties (if they indeed are proven to exist) are not known (De Los Angeles et al., 2012; Hanna et al., 2010b).

Multicellular organisms have evolved tissue homeostasis mechanisms to ensure life-long fitness of their organs and systems. Among these mechanisms, those that regulate the elimination of unwanted less-fit cells are fundamental for tissue development and homeostasis. Whereas overtly damaged or hyper proliferative cells usually trigger well-characterized cell-autonomous apoptotic pathways or cause cancer, mechanisms that survey viable cell fitness to optimize a tissue's cell composition are less well understood. A candidate mechanism is the phenomenon of "Cell Competition" (also known as "Cell Cheating"), first described in *Drosophila*.

Studies in flies have shown that the cells of growing organs are able to compare their fitness with that of neighboring cells, and the less-fit but otherwise viable cells are eliminated (out-competed) when confronted with a fitter cell population (competitor). Cell competition for survival is an active process because, in addition to a contribution from differential proliferation, it is executed through the apoptotic or senescence mediated elimination of the less-fit population by cell non-autonomous mechanisms. Cell parameters that trigger competition in flies include differences in protein synthesis capacity, growth factor receptivity and the expression level of dMyc, a major activator of cell anabolism. Super competition or Cheating is a variant of cell competition in which cells moderately overexpressing Myc outcompete wild-type (WT) cells. The replacement of cell populations through cell competition is phenotypically silent, because the competitor cells mostly conform to size-control mechanisms. This process is potentially important for the long-term maintenance of tissue performance, as it might provide a mechanism for elimination of suboptimal cells from stem-cell niches and progenitor-cell pools. In addition, cell competition for survival might serve to enhance tissue replacement during regeneration.

Recently cell competition has been characterized in mice. One study showed that cell competition is promoted by an imbalance in Myc dose between neighboring cells in the mouse epiblast E6.5 stage, and that c-Myc overexpressing cells in the mouse embryo behave like "cheaters" and outcompete their neighbors within the same mouse embryo belonging to the same species (Dejosez M et al., 2013. "Safeguards for cell cooperation in mouse embryogenesis shown by genome-wide cheater screen". Science. 2013 Sep. 27; 341(6153):1511-4; and Claveria C., et al., 2013. "Myc-driven endogenous cell competition in the early mammalian embryo". Nature. 2013 Aug. 1; 500(7460):39-44). Other studies showed that partial or complete depletion of P53 in mouse embryonic stem cells or in hematopoietic stem cells endows them the ability to outcompete WT mouse cells in the same.

Additional background art includes Xu Y., et al., 2013 (Journal of Biological Chemistry, 288: 9767-9778); Luo M., et al., 2013 (Stem Cells. March 26. doi: 10.1002/stem. 1374. [Epub ahead of print]); International Application No. PCT/US08/04516 ("Reprogramming of Somatic Cells", Jaenisch; Rudolf; et al.); Kim, H., Wu, J., Ye, S., Tai, C.-I., Zhou, X., Yan, H., Li, P., Pera, M., and Ying, Q.-L. (2013). Modulation of b-catenin function maintains mouse epiblast stem cell and human embryonic stem cell self-renewal. Nature Communications 4, 1-11; Li, X., Zhu, L., Yang, A., Lin, J., Tang, F., Jin, S., Wei, Z., Li, J., and Jin, Y. (2011). Calcineurin-NFAT Signaling Critically Regulates Early Lineage Specification in Mouse Embryonic Stem Cells and Embryos. Stem Cell 8, 46-58 and Shimizu, T., Ueda, J., Ho, J. C., Iwasaki, K., Poellinger, L., Harada, I., and Sawada, Y. (2012). Dual Inhibition of Src and GSK3 Maintains Mouse Embryonic Stem Cells, Whose Differentiation Is Mechanically Regulated by Src Signaling. Stem Cells 30, 1394-1404.

SUMMARY OF THE INVENTION

According to an aspect of some embodiments of the present invention there is provided a culture medium comprising a STAT3 activator, an ERK1/2 inhibitor and an Axin stabilizer.

According to some embodiments of the invention, the culture medium further comprising a PKC inhibitor.

According to an aspect of some embodiments of the present invention there is provided a culture medium comprising a STAT3 activator, an ERK1/2 inhibitor, an Axin stabilizer and a PKC inhibitor.

According to some embodiments of the invention, the culture medium further at least one agent selected from the group consisting of: a ROCK inhibitor, a SRC inhibitor, ascorbic acid, a PKA agonist, a YAP/TAZ inhibitor, a NOTCH inhibitor, an SHH inhibitor, a TGFβR inhibitor, a BMP inhibitor, an FGFR inhibitor, a JNK inhibitor, an ERK5 inhibitor, a BRAF inhibitor, an ARAFi, a CRAFi, a p38 inhibitor, a GSK3b inhibitor, an LSD1 inhibitor, a PI3K activator, a SMAD activator and a DOT1L inhibitor.

According to some embodiments of the invention, the SMAD activator is selected from the group consisting of: activin A, TGFβ1 and BMP4.

According to some embodiments of the invention, the PI3K activator is selected from the group consisting of: IGF1, IGF2, SCF and FGF2.

According to some embodiments of the invention, the medium further comprising a GSK3b inhibitor.

According to an aspect of some embodiments of the present invention there is provided a culture medium a STAT3 activator, an ERK1/2 inhibitor, an Axin stabilizer, a PKC inhibitor and a GSK3b inhibitor.

According to some embodiments of the invention, the culture medium further comprising at least one agent selected from the group consisting of: a ROCK inhibitor, an SRC inhibitor, ascorbic acid, a PKA agonist, a YAP/TAZ inhibitor, a NOTCH inhibitor, an SHH inhibitor, a TGFβR inhibitor, a BMP inhibitor, an FGFR inhibitor, a JNK inhibitor, an ERK5 inhibitor, a BRAF inhibitor, an ARAFi, a CRAFi, a p38 inhibitor, an LSD1 inhibitor, a PI3K activator, a SMAD activator and a DOT1L inhibitor.

According to some embodiments of the invention, the culture medium further comprising at least one agent selected from the group consisting of: basic fibroblast growth factor (bFGF), transforming growth factor beta 1 (TGFβ1), ACTIVIN A, a GSK3b inhibitor, a ROCK inhibitor, a P38 inhibitor, a JNK inhibitor, a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, an inhibitor of G9a and/or G1p (e.g., BIX01294 or UNC0638), stem cell factor (SCF), YAP/TAZ inhibitor, L-Ascorbic Acid, LSD1 inhibitor, and a DOT1L inhibitor.

According to some embodiments of the invention, the culture medium further comprising at least one agent selected from the group consisting of: a transforming growth factor receptor (TGFR) inhibitor, a fibroblast growth factor receptor (FGFR) inhibitor, ACTIVIN A, a GSK3b inhibitor, a ROCK inhibitor, a P38 inhibitor, a JNK inhibitor, a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, an inhibitor of G9a and/or G1p (e.g., BIX01294 or UNC0638), stem cell factor (SCF), YAP/TAZ inhibitor, L-Ascorbic Acid, LSD1 inhibitor, and DOT1L inhibitor.

According to some embodiments of the invention, the culture medium further comprising at least one agent selected from the group consisting of: Activin A, transforming growth factor beta 1 (TGFβ1), a fibroblast growth factor receptor (FGFR) inhibitor, a GSK3b inhibitor, a ROCK inhibitor, a P38 inhibitor, a JNK inhibitor, a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, an inhibitor of G9a and/or G1p (e.g., BIX01294 or UNC0638), stem cell factor (SCF), YAP/TAZ inhibitor, L-Ascorbic Acid, LSD1 inhibitor, and DOT1L inhibitor.

According to some embodiments of the invention, the culture medium further comprising at least one agent selected from the group consisting of: basic fibroblast growth factor (bFGF), a transforming growth factor receptor (TGFR) inhibitor, a GSK3b inhibitor, a ROCK inhibitor, a P38 inhibitor, a JNK inhibitor, a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, an inhibitor of G9a and/or G1p (e.g., BIX01294 or UNC0638), stem cell factor (SCF), YAP/TAZ inhibitor, L-Ascorbic Acid, LSD1 inhibitor, and DOT1L inhibitor.

According to an aspect of some embodiments of the present invention there is provided a culture medium comprising an ERK1/2 inhibitor, a STAT3 activator and a SRC inhibitor.

According to some embodiments of the invention, the culture medium further comprising an AXIN complex stabilizer (AXINs).

According to some embodiments of the invention, the culture medium further comprising a GSK3β inhibitor.

According to some embodiments of the invention, the culture medium further comprising a p38 inhibitor.

According to an aspect of some embodiments of the present invention there is provided a culture medium comprising an ERK1/2 inhibitor, a GSK3β inhibitor, a p38 inhibitor, a STAT3 activator and at least one agent selected from the group consisting of a SRC inhibitor and an AXIN complex stabilizer (AXINs).

According to an aspect of some embodiments of the present invention there is provided a culture medium comprising an ERK1/2 inhibitor, a GSK3β inhibitor, a p38 inhibitor, a JNK inhibitor, a STAT3 activator, a transforming growth factor beta receptor (TGFβR) inhibitor, a PKC inhibitor, a p38 inhibitor and basic fibroblast growth factor (bFGF).

According to an aspect of some embodiments of the present invention there is provided a cell culture comprising cells and the culture medium of some embodiments of the invention.

According to an aspect of some embodiments of the present invention there is provided a method of generating a naive pluripotent stem cell (PSC), comprising:

incubating a non-naive PSC cell in the culture medium of some embodiments of the invention, which allow generation of the naive PSC from the non-naive PSC, wherein:
- (i) when the naive PSC is a female PSC, then the naive female PSC has two unmethylated alleles of the promoter of the X-inactive specific transcript (XIST) gene; and
- (ii) when the naive PSC is a male PSC, then the naive male PSC has an unmethylated allele of the promoter of the XIST gene; and/or
- an expression level of transcription factor E3 (TFE3) in the naive PSC is characterized by a nucleus to cytoplasm expression ratio which is equal to or higher than 1 as determined by an immunostaining assay; and/or
- the naïve PSC is characterized by a positive expression of C-KIT (CD117) on the cell surface of the naïve PSC, thereby generating the naive PSC.

According to an aspect of some embodiments of the present invention there is provided a method of generating a naive pluripotent stem cell (PSC), comprising incubating a non-naive PSC cell under conditions which allow generation of the naive PSC from the non-naive PSC, the naive PSC comprising:
- an unmethylated X-inactive specific transcript (XIST) gene, wherein:
  - (i) when the naive PSC is a female PSC, then the naive female PSC has two unmethylated alleles of the promoter of the XIST gene; and
  - (ii) when the naive PSC is a male PSC, then the naive male PSC has an unmethylated allele of the promoter of the XIST gene,
- and/or
- an expression level of transcription factor E3 (TFE3) characterized by a nucleus to cytoplasm expression ratio which is equal to or higher than 1 as determined by an immunostaining assay,
- wherein the conditions comprise a culture medium which comprises KO-DMEM, N2 supplement (Gibco), B27 supplement, LIF, ERK1/2 inhibitor, PKC inhibitor, Axin stabilizer thereby generating the naive PSC.

According to an aspect of some embodiments of the present invention there is provided a method of generating a naive pluripotent stem cell (PSC), comprising incubating a non-naive PSC cell under conditions which allow generation of the naive PSC from the non-naive PSC, the naive PSC comprising:
- an unmethylated X-inactive specific transcript (XIST) gene, wherein:
  - (i) when the naive PSC is a female PSC, then the naive female PSC has two unmethylated alleles of the promoter of the XIST gene; and
  - (ii) when the naive PSC is a male PSC, then the naive male PSC has an unmethylated allele of the promoter of the XIST gene,
- and/or
- an expression level of transcription factor E3 (TFE3) characterized by a nucleus to cytoplasm expression ratio which is equal to or higher than 1 as determined by an immunostaining assay,
- wherein the conditions comprise a culture medium which comprises DMEM-F12/NEURObasal (GIBCO) 1:1 mix, N2 supplement (Gibco), B27 supplement (GIBCO), LIF (STAT3 activator), ERK1/2 inhibitor, PKC inhibitor, Axin stabilizer thereby generating the naive PSC.

According to an aspect of some embodiments of the present invention there is provided a method of generating a naive pluripotent stem cell (PSC), comprising incubating a non-naive PSC cell under conditions which allow generation of the naive PSC from the non-naive PSC, the naive PSC comprising:
- an unmethylated X-inactive specific transcript (XIST) gene, wherein:
  - (i) when the naive PSC is a female PSC, then the naive female PSC has two unmethylated alleles of the promoter of the XIST gene; and
  - (ii) when the naive PSC is a male PSC, then the naive male PSC has an unmethylated allele of the promoter of the XIST gene,
- and/or
- an expression level of transcription factor E3 (TFE3) characterized by a nucleus to cytoplasm expression ratio which is equal to or higher than 1 as determined by an immunostaining assay,
- wherein the conditions comprise a culture medium which comprises DMEM-F12, N2 supplement (Gibco), B27 supplement, LIF (STAT3 activator), ERK1/2 inhibitor, PKC inhibitor, Axin stabilizer thereby generating the naive PSC.

According to an aspect of some embodiments of the present invention there is provided a method of generating a naive pluripotent stem cell (PSC), comprising incubating a non-naive PSC cell under conditions which allow generation of the naive PSC from the non-naive PSC, the naive PSC comprising:
- an unmethylated X-inactive specific transcript (XIST) gene, wherein:
  - (i) when the naive PSC is a female PSC, then the naive female PSC has two unmethylated alleles of the promoter of the XIST gene; and
  - (ii) when the naive PSC is a male PSC, then the naive male PSC has an unmethylated allele of the promoter of the XIST gene,
- and/or
- an expression level of transcription factor E3 (TFE3) characterized by a nucleus to cytoplasm expression ratio which is equal to or higher than 1 as determined by an immunostaining assay,
- wherein the conditions comprise a culture medium which comprises KO-DMEM, N2 supplement (Gibco), B27 supplement, LIF, ERK1/2 inhibitor, GSK3b inhibitor, PKC inhibitor, Axin stabilizer thereby generating the naive PSC.

According to an aspect of some embodiments of the present invention there is provided a method of generating a naive pluripotent stem cell (PSC), comprising incubating a non-naive PSC cell under conditions which allow generation of the naive PSC from the non-naive PSC, the naive PSC comprising:
- an unmethylated X-inactive specific transcript (XIST) gene, wherein:
  - (i) when the naive PSC is a female PSC, then the naive female PSC has two unmethylated alleles of the promoter of the XIST gene; and
  - (ii) when the naive PSC is a male PSC, then the naive male PSC has an unmethylated allele of the promoter of the XIST gene,
- and/or
- an expression level of transcription factor E3 (TFE3) characterized by a nucleus to cytoplasm expression ratio which is equal to or higher than 1 as determined by an immunostaining assay,
- wherein the conditions comprise a culture medium which comprises DMEM-F12/NEURObasal (GIBCO) 1:1 mix, N2 supplement (Gibco), B27 supplement (GIBCO), LIF (STAT3 activator), ERK1/2 inhibitor, GSK3b inhibitor, PKC inhibitor, Axin stabilizer thereby generating the naive PSC.

According to an aspect of some embodiments of the present invention there is provided a method of generating a naive pluripotent stem cell (PSC), comprising incubating a non-naive PSC cell under conditions which allow generation of the naive PSC from the non-naive PSC, the naive PSC comprising:
an unmethylated X-inactive specific transcript (XIST) gene, wherein:
(i) when the naive PSC is a female PSC, then the naive female PSC has two unmethylated alleles of the promoter of the XIST gene; and
(ii) when the naive PSC is a male PSC, then the naive male PSC has an unmethylated allele of the promoter of the XIST gene,
and/or
an expression level of transcription factor E3 (TFE3) characterized by a nucleus to cytoplasm expression ratio which is equal to or higher than 1 as determined by an immunostaining assay,
wherein the conditions comprise a culture medium which comprises DMEM-F12, N2 supplement (Gibco), B27 supplement, LIF (STAT3 activator), ERK1/2 inhibitor, GSK3b inhibitor, PKC inhibitor, Axin stabilizer thereby generating the naive PSC.

According to some embodiments of the invention, incubating is performed under culture conditions devoid of feeder cells.

According to some embodiments of the invention, incubating is performed under culture conditions which comprise culturing on feeder cells.

According to an aspect of some embodiments of the present invention there is provided a method of improving generation of induced pluripotent stem cells (iPSCs) from a somatic cell, comprising:
(a) expressing within the somatic cell a first factor selected from the group consisting of Nanog, ESRRB, KLF2, TBX3, ERAS and KLF17, and a second factor selected from the group consisting of Nanog, ESRRB, KLF2, TBX3, ERAS, Oct4, Sox2, Klf4, c-Myc, and KLF17, wherein the first and second factor are non-identical; and
(b) inhibiting Mbd3 and/or Gatad2a expression and/or activity in the somatic cell, thereby improving generation of the iPSCs from a somatic cell.

According to some embodiments of the invention, the culture medium further comprises a ROCK inhibitor.

According to some embodiments of the invention, the culture medium further comprises a JNK inhibitor.

According to some embodiments of the invention, the culture medium further comprises at least one agent selected from the group consisting of basic fibroblast growth factor (bFGF), transforming growth factor (TGF) inducer, a transforming growth factor receptor (TGFR) inhibitor and a fibroblast growth factor receptor (FGFR) inhibitor.

According to some embodiments of the invention, the culture medium further comprises at least two agents selected from the group consisting of: basic fibroblast growth factor (bFGF), transforming growth factor (TGF) inducer, a transforming growth factor receptor (TGFR) inhibitor and a fibroblast growth factor receptor (FGFR) inhibitor.

According to some embodiments of the invention, the culture medium further comprises a TGF inducer, wherein the TGF inducer is selected from the group consisting of transforming growth factor beta 1 (TGFβ1), transforming growth factor beta 2 (TGFβ2) and Activin.

According to some embodiments of the invention, the TGF inducer is selected from the group consisting of transforming growth factor beta 1 (TGFβ1), transforming growth factor beta 2 (TGFβ2) and Activin.

According to some embodiments of the invention, the culture medium further comprises a protein kinase C (PKC) inhibitor and/or a BMP inhibitor.

According to some embodiments of the invention, the culture medium further comprises at least one additional agent selected from the group consisting of: insulin-like growth factor 1 (IGF1), insulin-like growth factor II (IGFII), bone morphogenetic protein 4 (BMP4), a Sonic Hedgehog pathway (SHH) inhibitor, an ERK5 inhibitor, Forskolin, Kenpaullone, BayK8644, an inhibitor of G9a and/or G1p (e.g., BIX01294 or UNC0638), and stem cell factor (SCF).

According to some embodiments of the invention, the culture medium further comprises a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor.

According to some embodiments of the invention, the culture medium comprises a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor and a PKC inhibitor.

According to some embodiments of the invention, the culture medium comprising a STAT3 activator, an ERK1/2 inhibitor, a GSK3β inhibitor, a P38 inhibitor, a bFGF, TGFβ1, a ROCK inhibitor, AXIN stabilizer, SRC family kinase inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor, a BMP inhibitor and a PKC inhibitor.

According to some embodiments of the invention, the culture medium comprises a STAT3 activator, an ERK1/2 inhibitor, a GSK3β inhibitor, a P38 inhibitor, a bFGF, TGFβ1, a ROCK inhibitor, AXIN stabilizer and SRC family kinase inhibitor.

According to some embodiments of the invention, the culture medium comprises a STAT3 activator, an ERK1/2 inhibitor, a GSK3β inhibitor, a P38 inhibitor, a bFGF, TGFβ1, a ROCK inhibitor, AXIN stabilizer, SRC family kinase inhibitor and a BMP inhibitor.

According to some embodiments of the invention, the culture medium comprises a STAT3 activator, an ERK1/2 inhibitor, a GSK3β inhibitor, a P38 inhibitor, a bFGF, TGFβ1, a ROCK inhibitor, AXIN stabilizer, SRC family kinase inhibitor and a PKC inhibitor.

According to some embodiments of the invention, the culture medium comprises a STAT3 activator, an ERK1/2 inhibitor, a GSK3β inhibitor, a P38 inhibitor, a bFGF, TGFβ1, a ROCK inhibitor, AXIN stabilizer, SRC family kinase inhibitor, a BMP inhibitor and a PKC inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, AXIN stabilizer and SRC family kinase inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, AXIN stabilizer, a SRC family kinase inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, AXIN stabilizer, a SRC family kinase inhibitor and a PKC inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, AXIN stabilizer, a SRC family kinase inhibitor, a PKC inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, FGF2, TGFβ1, a ROCK inhibitor and a SRC family kinase inhibitor.

According to some embodiments of the invention, the culture medium comprises a STAT3 activator, an ERK1/2 inhibitor, a GSK3β inhibitor, a P38 inhibitor, a JNK inhibitor, FGF2, TGFβ1, a ROCK inhibitor, a SRC family kinase inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, FGF2, TGFβ1, a ROCK inhibitor, a SRC family kinase inhibitor and a PKC inhibitor.

According to some embodiments of the invention, the culture medium comprises a STAT3 activator, an ERK1/2 inhibitor, a GSK3β inhibitor, a P38 inhibitor, a JNK inhibitor, FGF2, TGFβ1, a ROCK inhibitor, a SRC family kinase inhibitor, a PKC inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor and a SRC family kinase inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, a SRC family kinase inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, a SRC family kinase inhibitor and a PKC inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, a SRC family kinase inhibitor, a PKC inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, a ROCK inhibitor, an AXIN stabilizer and a SRC family kinase inhibitor.

According to some embodiments of the invention, the culture medium comprises a STAT3 activator, an ERK1/2 inhibitor, a GSK3β inhibitor, a P38 inhibitor, a JNK inhibitor, a ROCK inhibitor, an AXIN stabilizer, a SRC family kinase inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, a ROCK inhibitor, an AXIN stabilizer, a SRC family kinase inhibitor and a PKC inhibitor.

According to some embodiments of the invention, the culture medium comprises a STAT3 activator, an ERK1/2 inhibitor, a GSK3β inhibitor, a P38 inhibitor, a JNK inhibitor, a ROCK inhibitor, an AXIN stabilizer, a SRC family kinase inhibitor, a PKC inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor and an AXIN stabilizer.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer and a PKC inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, a PKC inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor and a FGF receptor inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor, a FGF receptor inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor, a FGF receptor inhibitor and a PKC inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor, a FGF receptor inhibitor, a PKC inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer and a FGF receptor inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, a FGF receptor inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, a FGF receptor inhibitor and a PKC inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, a FGF receptor inhibitor, a PKC inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, Src family kinase inhibitor and a TGF receptor inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, Src family kinase inhibitor, a TGF receptor inhibitor and a BMP inhibitor.

According to some embodiments of the invention, the culture medium comprises a STAT3 activator, an ERK1/2 inhibitor, a GSK3β inhibitor, a P38 inhibitor, a JNK inhibitor, TGFβ1, a ROCK inhibitor, an AXIN stabilizer, Src family kinase inhibitor, a TGF receptor inhibitor and a PKC inhibitor.

According to some embodiments of the invention, the culture medium comprises a STAT3 activator, an ERK1/2 inhibitor, a GSK33 inhibitor, a P38 inhibitor, a JNK inhibitor, TGFβ1, a ROCK inhibitor, an AXIN stabilizer, Src family kinase inhibitor, a TGF receptor inhibitor, a PKC inhibitor and a BMP inhibitor.

According to some embodiments of the invention, the STAT3 activator is selected from the group consisting of leukemia inhibitory factor (LIF) and interleukin 6 (IL6).

According to some embodiments of the invention, the culture medium comprises at least one agent selected from the group consisting of a BMP inhibitor, a ROCK inhibitor, a SRC inhibitor and an AXIN complex stabilizer (AXINs).

According to some embodiments of the invention, the culture medium which comprises an ERK1/2 inhibitor, a GSK3β inhibitor, a p38 inhibitor, a JNK inhibitor, a STAT3 activator, a transforming growth factor beta receptor (TGFβR) inhibitor, a PKC inhibitor, a p38 inhibitor and basic fibroblast growth factor (bFGF), further comprises at least one agent selected from the group consisting of a BMP inhibitor, a ROCK inhibitor, a SRC inhibitor and an AXIN complex stabilizer (AXINs).

According to some embodiments of the invention, the culture medium further comprises a supplement selected from the group consisting of N2 supplement and B27 supplement.

According to some embodiments of the invention, the culture medium further comprises ascorbic acid.

According to some embodiments of the invention, the culture medium further comprises oleic Acid.

According to some embodiments of the invention, the culture medium further comprises Linoleic Acid and/or pipecolic acid.

According to some embodiments of the invention, the culture medium is devoid of animal serum.

According to some embodiments of the invention, the culture medium further comprises serum replacement.

According to some embodiments of the invention, the medium is capable of maintaining pluripotent stem cells in an undifferentiated state for at least 2 passages.

According to some embodiments of the invention, the pluripotent stem cells are naïve pluripotent stem cells.

According to some embodiments of the invention, the culture medium further comprises an MBD3 inhibitor.

According to some embodiments of the invention, the culture medium further comprises a chromodomain helicase DNA binding protein 4 (CHD4) inhibitor.

According to some embodiments of the invention, the culture medium further comprises P66 alpha coiled-coil domain or p66alpha inhibitor.

According to some embodiments of the invention, the non-naive PSC is selected from the group consisting of a primed PSC, a blastocyst, an induced pluripotent stem cell (iPSC) and a somatic cell.

According to some embodiments of the invention, the non-naive PSC comprises a somatic cell then the method further comprises subjecting the somatic cell to de-differentiation conditions, to thereby obtain an induced pluripotent stem cell.

According to some embodiments of the invention, the de-differentiation conditions comprise exogenously expressing within the somatic cell at least two factors selected from the group consisting of Oct4, Sox2, Klf4, Nanog, ESRRB, KLF2, TBX3, ERAS, c-Myc and KLF17.

According to some embodiments of the invention, the inhibiting the Mbd3 activity is performed by inhibiting binding of the Mbd3 to the nucleosome remodeling and deacetylase (NuRD) complex.

According to some embodiments of the invention, the inhibiting the binding of the Mbd3 to the NuRD complex is performed using a chromodomain helicase DNA binding protein 4 (CHD4) inhibitor.

According to some embodiments of the invention, the inhibiting the binding of the Mbd3 to the NuRD complex is performed using a P66 alpha coiled-coil domain.

According to some embodiments of the invention, inhibiting the Mbd3 activity is performed by inhibiting binding of the Mbd3 to the nucleosome remodeling and deacetylase (NuRD) complex, wherein inhibiting the binding of the Mbd3 to the NuRD complex is performed using a P66 alpha coiled-coil domain.

According to some embodiments of the invention, the inhibiting the Mbd3 expression is performed using a protein kinase C (PKC) inhibitor.

According to some embodiments of the invention, the method further comprises exogenously expressing ES cell expressed Ras (ERAS) coding sequence or activating endogenous expression of the ERAS in the somatic cell.

According to some embodiments of the invention, the expressing is effected for at least 48 hours such that the inhibiting the Mbd3 is effected to 10-30% of a level of the Mbd3 prior to the expressing.

According to some embodiments of the invention, the expressing is effected for about 48 hours and the inhibiting is effected after the about 48 hours.

According to some embodiments of the invention, the iPSC is a murine iPSC.

According to some embodiments of the invention, the method further comprises culturing the murine iPSC in a medium which comprises LIF, an ERK1/2 inhibitor and a GSK3b inhibitor.

According to some embodiments of the invention, the medium further comprises an agent selected from the group consisting of a SRC inhibitor and an AXIN complex stabilizer (AXINs).

According to some embodiments of the invention, when the iPSC is a human iPSC, the method further comprising:

(c) culturing the human iPSC in a culture medium which comprises LIF, an ERK1/2 inhibitor, a GSK3b inhibitor, a P38 inhibitor, a JNK inhibitor, basic fibroblast growth factor (bFGF) and transforming growth factor-beta 1 (TGFβ1).

According to some embodiments of the invention, the medium further comprises a ROCK inhibitor.

According to some embodiments of the invention, the medium further comprises SRC inhibitor and an AXIN complex stabilizer (AXINs).

According to some embodiments of the invention, the step (c) is performed following about 48 hours from the expressing of step (a).

According to some embodiments of the invention, the expressing is performed using DNA transfection of the factors.

According to some embodiments of the invention, the expressing is performed using RNA transfection of the factors.

According to some embodiments of the invention, the expressing is performed using protein transfection of the factors.

According to some embodiments of the invention, the unmethylated alleles of the promoter of the XIST gene in a female cell comprise less than 20% of CpG sites in the XIST promoter amplicon set forth by SEQ ID NO:70 being methylated.

According to some embodiments of the invention, the unmethylated allele of the promoter of the XIST gene in a male cell comprises less than 20% of CpG sites in the XIST promoter amplicon set forth by SEQ ID NO:70 being methylated.

According to some embodiments of the invention, the inhibitor of the G9a and/or the inhibitor of the G1p is selected from the group consisting of: BIX01294 and UNC0638.

According to some embodiments of the invention, the inhibitor of the G9a and/or the inhibitor of the G1p is BIX01294.

According to an aspect of some embodiments of the present invention there is provided an isolated naïve pluripotent stem cell genetically modified to over-express an oncogenic protein selected from the group consisting of: C-MYC, N-MYC, L-MYC, EDAR (ectodysplasin A receptor), MDM2, and ERAS, and/or to downregulate a tumor suppressor protein selected from the group consisting of P53 and NF kappa B inhibitor alpha.

According to some embodiments of the invention, the downregulation of said tumor suppressor gene is performed by introducing into the cell a dominant negative mutant of said tumor suppressor protein.

According to some embodiments of the invention, the dominant negative of said tumor suppressor protein comprises the P53 R172H dominant negative mutation in the P53 protein set forth in GenBank Accession No. AAA39883.1 (SEQ ID NO:212).

According to some embodiments of the invention, the dominant negative of said tumor suppressor protein comprises the R175H, G245S, R248W, R249S, R273H and/or R282W dominant negative mutation(s) in the P53 protein set forth in GenBank Accession No. BAC16799.1 (SEQ ID NO:210).

According to some embodiments of the invention, the dominant negative of said tumor suppressor protein comprises the S32D and S36D mutations, the S32E and S36E mutations, the S32D and S36E mutations and/or the S32E and S36D mutations in the NF kappa B inhibitor alpha protein set forth in GenBank Accession No. NP_065390.1 (SEQ ID NO:211).

According to some embodiments of the invention, the genetically modified isolated naïve pluripotent stem cell of some embodiments of the invention is characterized by:
wherein
(i) when said naive PSC is a female PSC, then said naive female PSC has two unmethylated alleles of the promoter of the X-inactive specific transcript (XIST) gene; and
(ii) when said naive PSC is a male PSC, then said naive male PSC has an unmethylated allele of said promoter of said XIST gene,
and/or
an expression level of transcription factor E3 (TFE3) in said naive PSC is characterized by a nucleus to cytoplasm expression ratio which is equal to or higher than 1 as determined by an immunostaining assay,
and/or
the naïve PSC is characterized by a positive expression of C-KIT (CD117) on the cell surface of the naïve PSC.

According to some embodiments of the invention, the naïve pluripotent stem cell is a primate cell.

According to some embodiments of the invention, the naïve pluripotent stem cell is a human cell.

According to an aspect of some embodiments of the present invention there is provided a method of generating a chimeric animal comprising introducing the isolated naïve pluripotent stem cell of some embodiments of the invention or the primordial germ cells of some embodiments of the invention into an embryo of a host animal, thereby generating the chimeric animal.

According to some embodiments of the invention, the embryo is a pre-implantation embryo.

According to some embodiments of the invention, the method further comprising allowing said pre-implantation embryo to grow ex vivo or in vivo.

According to some embodiments of the invention, the introducing is performed in vivo.

According to some embodiments of the invention, the introducing is performed in vitro or ex vivo.

According to some embodiments of the invention, the pre-implantation embryo comprises at least 4 cells.

According to some embodiments of the invention, the pre-implantation embryo comprises no more than 128 cells.

According to some embodiments of the invention, the host animal is a mouse.

According to some embodiments of the invention, the isolated naïve pluripotent stem cell is allogeneic to the host animal.

According to some embodiments of the invention, the isolated naïve pluripotent stem cell is xenogeneic to the host animal.

According to an aspect of some embodiments of the present invention there is provided a cell culture comprising the isolated naïve pluripotent stem cell of some embodiments of the invention and a culture medium.

According to some embodiments of the invention, the culture medium is capable of maintaining said pluripotent stem cell in a naïve state for at least 5 passages.

According to some embodiments of the invention, the culture medium included in the cell culture of the invention is any of the culture media described hereinabove and herein under.

According to some embodiments of the invention, the culture medium included in the cell culture of the invention is the culture medium of some embodiments of the invention. According to some embodiments of the invention, the culture medium included in the cell culture of the invention is any of the culture media 1-147.

According to some embodiments of the invention, the culture medium included in the cell culture of the invention is any of the culture media described in WO2014/174470 which is fully incorporated herein by reference in its entirety.

According to some embodiments of the invention, the culture medium included in the cell culture of the invention comprises an ERK1/2 inhibitor, a GSK3β inhibitor, a p38 inhibitor, a JNK inhibitor, a STAT3 activator and at least one agent selected from the group consisting of: basic fibroblast growth factor (bFGF), transforming growth factor beta 1 (TGFβ1), a protein kinase C (PKC) inhibitor, a ROCK inhibitor and a NOTCH inhibitor.

According to some embodiments of the invention, the culture medium included in the cell culture of the invention comprises an ERK1/2 inhibitor, a GSK3β inhibitor, a p38 inhibitor, a JNK inhibitor, a STAT3 activator and at least one agent selected from the group consisting of: a transforming growth factor receptor (TGFR) inhibitor, a fibroblast growth factor receptor (FGFR) inhibitor, a protein kinase C (PKC) inhibitor, a ROCK inhibitor and a NOTCH inhibitor.

According to some embodiments of the invention the STAT3 activator is selected from the group consisting of leukemia inhibitory factor (LIF) and interleukin 6 (IL6).

According to some embodiments of the invention the culture medium further comprising at least one additional agent selected from the group consisting of: insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, Bix1294, and stem cell factor (SCF).

According to some embodiments of the invention the culture medium further comprising at least one additional agent selected from the group consisting of: insulin-like growth factor 1 (IGF1), insulin-like growth factor II (IGFII), bone morphogenetic protein 4 (BMP4), a Sonic Hedgehog pathway (SHH) inhibitor, an ERK5 inhibitor, Forskolin, Kenpaullone, BayK8644, Bix1294, and stem cell factor (SCF).

According to some embodiments of the invention, the STAT3 activator comprises the LIF, and wherein the at least one agent comprises the PKC inhibitor.

According to some embodiments of the invention, the STAT3 activator comprises the LIF, and wherein the at least one agent comprises the TGFβ1 and the protein kinase C inhibitor.

According to some embodiments of the invention, the culture medium further comprises an FGFR inhibitor.

According to some embodiments of the invention, the culture medium further comprises TGFR inhibitor.

According to some embodiments of the invention, the STAT3 activator comprises the LIF and wherein the at least one agent comprises the TGFβ1 and the protein kinase C inhibitor.

According to some embodiments of the invention, the culture medium further comprises an FGFR inhibitor.

According to some embodiments of the invention, the STAT3 activator comprises the LIF, and wherein the at least one agent comprises the bFGF and the TGFβ1.

According to some embodiments of the invention, the culture medium further comprises a ROCK inhibitor.

According to some embodiments of the invention, the culture medium further comprises a protein kinase C inhibitor.

According to some embodiments of the invention, the STAT3 activator comprises the LIF and wherein the at least one agent comprises the bFGF, the ROCK inhibitor, a bone morphogenetic protein (BMP) inhibitor, the NOTCH inhibitor, and a transforming growth factor receptor (TGFR) inhibitor.

According to some embodiments of the invention, the culture medium further comprises a Sonic Hedgehog pathway (SHH) inhibitor.

According to some embodiments of the invention, the STAT3 activator comprises the LIF and wherein the at least one agent comprises the NOTCH inhibitor, and a fibroblast growth factor receptor (FGFR) inhibitor.

According to some embodiments of the invention, the culture medium further comprises an agent selected from the group consisting of insulin-like growth factor II (IGFII), stem cell factor (SCF) and transforming growth factor beta 1 (TGFβ1).

According to an aspect of some embodiments of the present invention there is provided a culture medium comprising leukemia inhibitor factor (LIF), an ERK1/2 inhibitor, a GSK3b inhibitor, a p38 inhibitor, a JNK inhibitor, and a protein kinase C inhibitor.

According to some embodiments of the invention, the culture medium of some embodiments of the invention further comprises an FGFR inhibitor.

According to some embodiments of the invention, the culture medium of some embodiments of the invention further comprises a TGFR inhibitor.

According to an aspect of some embodiments of the present invention there is provided a culture medium comprising leukemia inhibitor factor (LIF), an ERK1/2 inhibitor, a GSK3b inhibitor, a p38 inhibitor, a JNK inhibitor, TGFβ1 and a protein kinase C inhibitor.

According to some embodiments of the invention, the culture medium of some embodiments of the invention further comprises a FGFR inhibitor.

According to an aspect of some embodiments of the present invention there is provided a culture medium comprising leukemia inhibitor factor (LIF), an ERK1/2 inhibitor, a GSK3b inhibitor, a p38 inhibitor, a JNK inhibitor, basic fibroblast growth factor (bFGF) and transforming growth factor-beta 1 (TGFβ1).

According to some embodiments of the invention, the culture medium of some embodiments of the invention further comprises a ROCK inhibitor.

According to some embodiments of the invention, the culture medium of some embodiments of the invention further comprises a protein kinase C inhibitor.

According to some embodiments of the invention, the culture medium of some embodiments of the invention further comprising a factor selected from the group consisting of: bone morphogenetic protein 4 (BMP4), IGF1, IGFII, Forskolin, FGFR inhibitor, TGFR inhibitor, Kenpaullone, BayK8644, Bix1294, and stem cell factor (SCF).

According to some embodiments of the invention, the culture medium of some embodiments of the invention further comprising BMP type I receptors (ALK2,3,6) inhibitor.

According to some embodiments of the invention, the culture medium of some embodiments of the invention further comprises ascorbic Acid.

According to some embodiments of the invention, the culture medium of some embodiments of the invention further comprises oleic Acid.

According to some embodiments of the invention, the culture medium of some embodiments of the invention further comprises Linoleic Acid.

According to some embodiments of the invention, the culture medium of some embodiments of the invention further comprises Pipecolic Acid.

According to some embodiments of the invention, the culture medium of some embodiments of the invention being devoid of animal serum.

According to some embodiments of the invention, the culture medium of some embodiments of the invention further comprises serum replacement.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying images. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1:
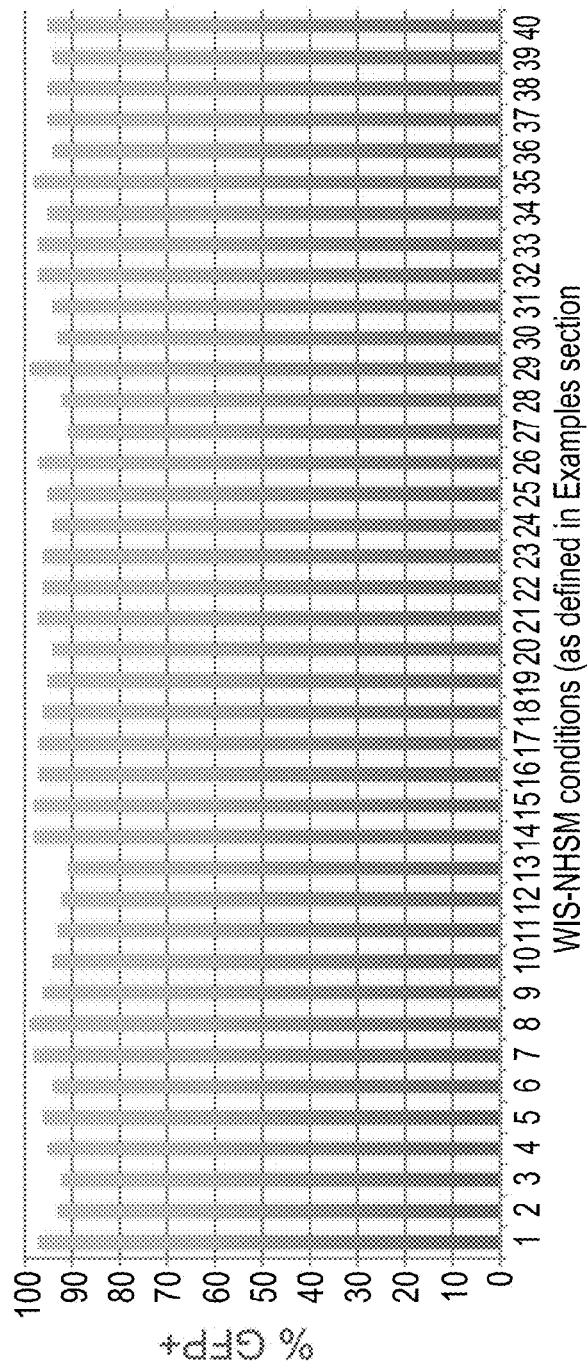

FIG. 1 is a graph illustrating FACS analysis of WIBR3 hESC line carrying Oct4-GFP reporter. The cells were expanded on Gelatin/DR4 feeder coated plates in 5% $O_2$ with the indicated supplements of conditions 1-40 to the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 µl of 50 mM stock Beta-mercaptoethanol (1 vile), 5 ml B27 supplement (Invitrogen 17504-044), Insulin (Sigma I-1882), Apo-transferrin (Sigma T-1147), 100 µg/ml final concentration, Progesterone (Sigma P8783), 0.02 µg/ml final concentration, Putrescine (SigmaP5780), 16 µg/ml final concentration, Sodium selenite (Sigma S5261), L-ascorbic acid 2-phosphate (Sigma A8960) (50 µg/ml final concentration), BSA (100× Fraction V 7.5% Solution Gibco 15260-037. The cells were expanded for up to 21 passages and evaluated by FACS analysis for OCT4-GFP+ reporter. The results show the cells maintain their pluripotency in the conditions described.

Figure 2:
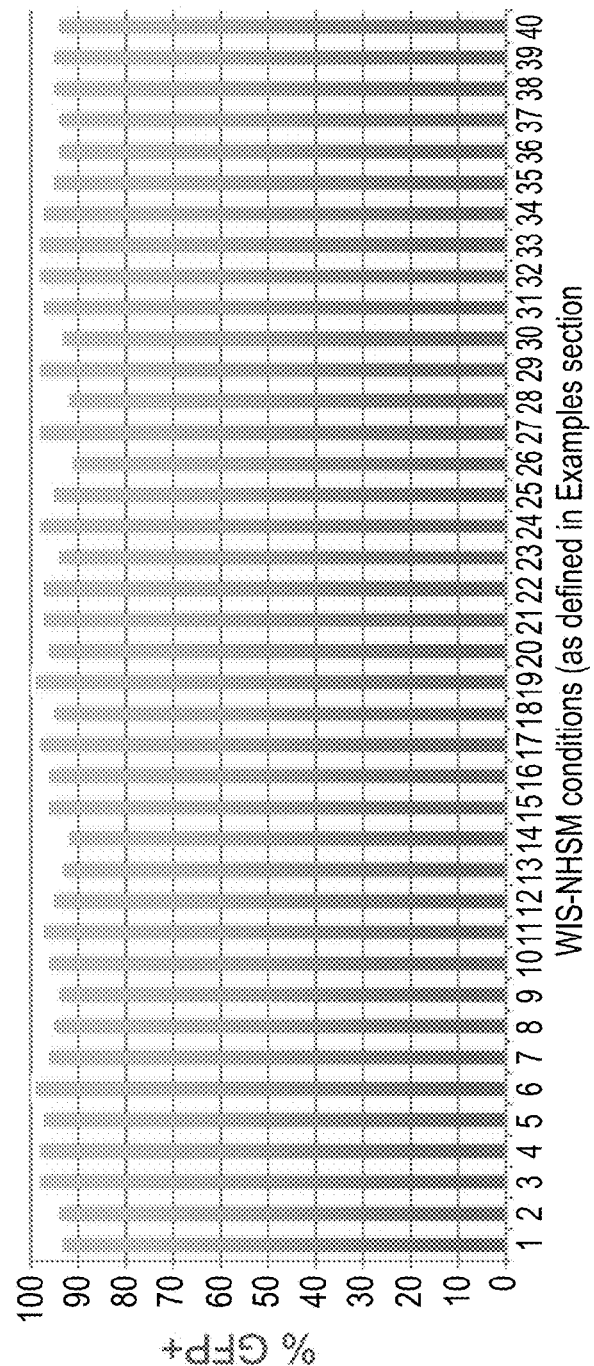

FIG. 2 is a graph illustrating FACS analysis of WIBR3 hESC line carrying deltaPEOct4-GFP reporter (described in Gafni et al. Nature 2013). The cells were expanded on Gelatin/DR4 feeder coated plates in 5% O2 with the indicated supplements of conditions 1-40 to the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 µL of 50 mM stock Beta-mercaptoethanol (1 vile), 5 ml B27 supplement (Invitrogen 17504-044), Insulin (Sigma I-1882) 12.5 microg/ml insulin), Apo-transferrin (Sigma T-1147), 100 µg/ml final concentration, Progesterone (Sigma P8783), 0.02 µg/ml final concentration, Putrescine (SigmaP5780), 16 µg/ml final concentration, Sodium selenite (Sigma S5261), add 5 µl of 3 mM stock solution per 500 ml of medium, L-ascorbic acid 2-phosphate (Sigma A8960) (50 µg/ml final concentration), BSA (100× Fraction V 7.5% Solution Gibco 15260-037. The cells were expanded for up to 21 passages and evaluated by FACS analysis for OCT4-GFP+ reporter. The results show the cells maintain their pluripotency in the conditions described.

Figure 3A:
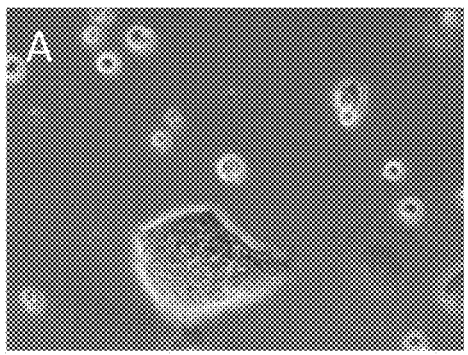
Figure 3B:
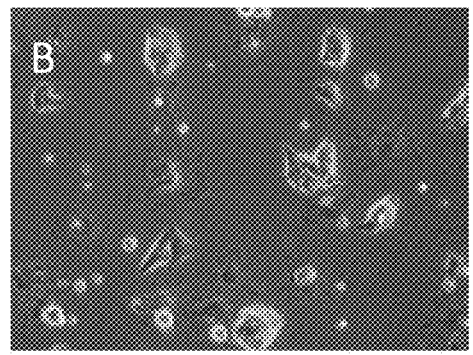
Figure 3C:
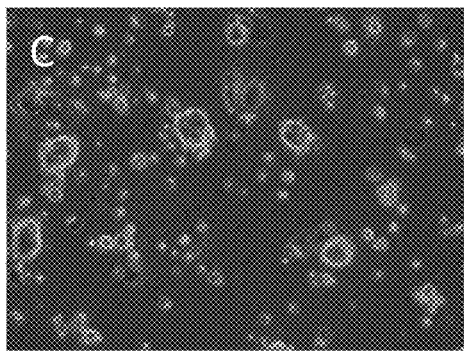
Figure 3D:
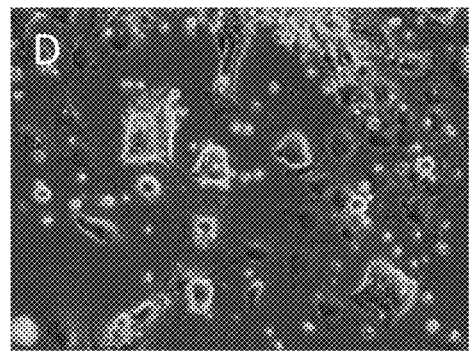
Figure 3E:
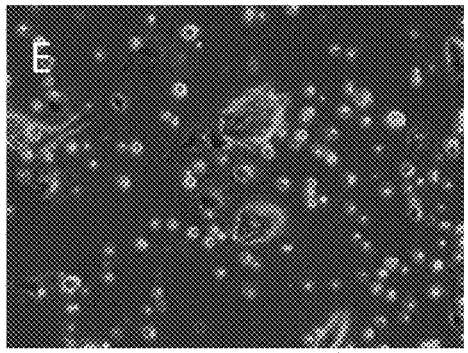
Figure 3F:
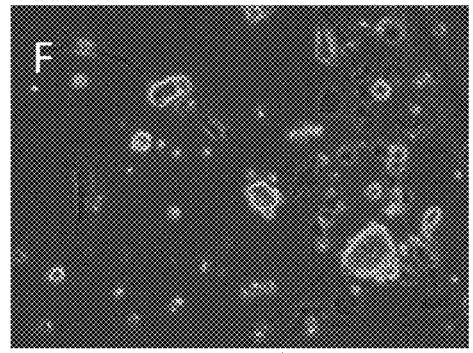

FIGS. 3A, 3B, 3C, 3D, 3E and 3F are representative images of pluripotent cell colonies at P12 in the selected conditions shown. FIG. 3A—conditions 1; FIG. 3B—conditions 2; FIG. 3C—conditions 3; FIG. 3D—conditions 4; FIG. 3E—conditions 9; FIG. 3F—conditions 11. The WIS2 hESC line was expanded on vitronectin coated plates in 5% O2 with the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 µL of 50 mM stock Beta-mercaptoethanol (1 vile), 5 ml B27 supplement (Invitrogen 17504-044), Insulin (Sigma I-1882)—12.5 microg/ml insulin), Apo-transferrin (Sigma T-1147), 100 µg/ml final concentration, Progesterone (Sigma P8783), 0.02 µg/ml final concentration, Putrescine (SigmaP5780), 16 µg/ml final concentration, Sodium selenite (Sigma S5261), add 5 µl of 3 mM stock solution per 500 ml of medium, L-ascorbic acid 2-phosphate (Sigma A8960) (50 µg/ml final concentration), BSA (100× Fraction V 7.5% Solution Gibco 15260-037.

Figure 4A:
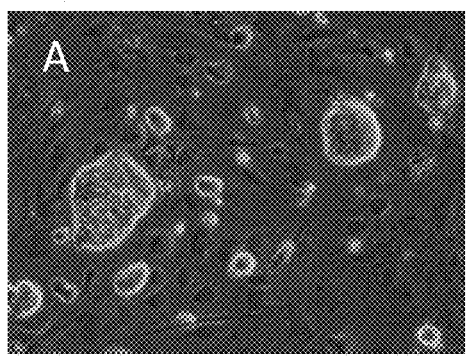
Figure 4B:
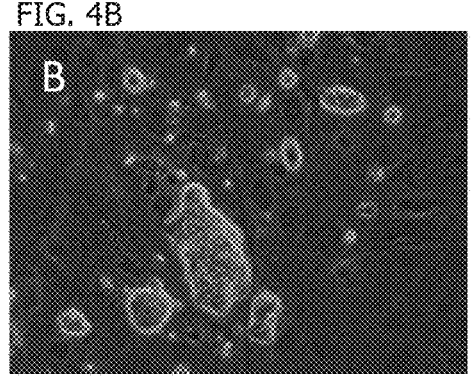
Figure 4C:
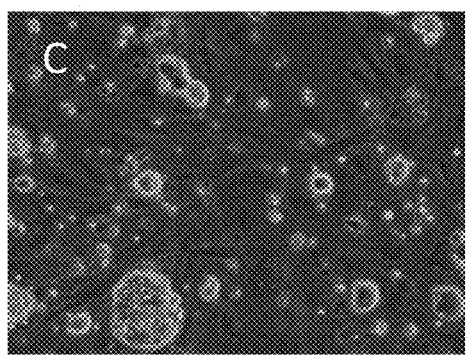
Figure 4D:
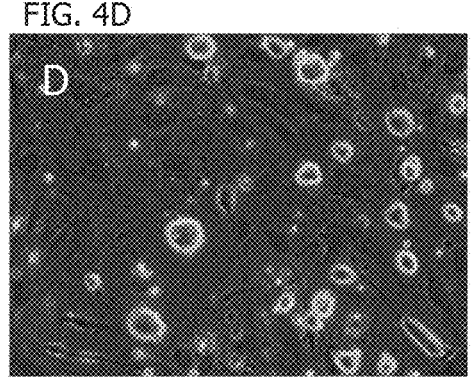

FIGS. 4A, 4B, 4C and 4D are representative images of pluripotent cell colonies at P20 in the selected conditions shown. FIG. 4A—conditions 9; FIG. 4B—conditions 10; FIG. 4C—conditions 11; FIG. 4D—conditions 4. The WIS2 hESC line was expanded on Gelatin/DR4 feeder cell coated plates in 5% $O_2$ with the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 µL of 50 mM stock Beta-mercaptoethanol (1 vile), 5 ml B27 supplement (Invitrogen 17504-044), Insulin (Sigma I-1882) 12.5 microg/ml insulin), Apo-transferrin (Sigma T-1147), 100 µg/ml final concentration, Progesterone (Sigma P8783), 0.02 µg/ml final concentration, Putrescine (SigmaP5780), 16 µg/ml final concentration, Sodium selenite (Sigma S5261), add 5 µl of 3 mM stock solution per 500 ml of medium., L-ascorbic acid 2-phosphate (Sigma A8960) (50 µg/ml final concentration), BSA (100× Fraction V 7.5% Solution Gibco 15260-037-0.16 ml per 500 ml media bottle.

Figure 5A:
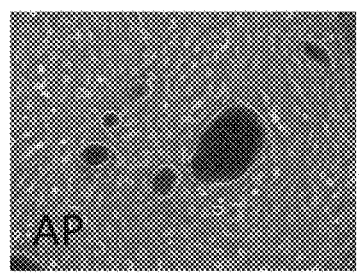
Figure 5B:
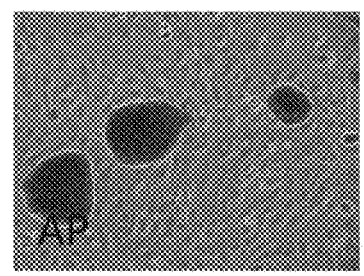
Figure 5C:

FIGS. 5A, 5B and 5C are representative images of pluripotent cell colonies at P18-20 in the selected conditions shown. FIG. 5A—conditions 9; FIG. 5B—conditions 10; FIG. 5C—conditions 4. WIS2 hESC line was expanded on Gelatin/DR4 feeder cell coated plates in 5% O2 with the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 μL of 50 mM stock Beta-mercaptoethanol (1 vile), 5 ml B27 supplement (Invitrogen 17504-044), Insulin (Sigma I-1882)—12.5 microg/ml insulin), Apo-transferrin (Sigma T-1147), 100 μg/ml final concentration, Progesterone (Sigma P8783), 0.02 μg/ml final concentration, Putrescine (SigmaP5780), 16 μg/ml final concentration, Sodium selenite (Sigma S5261), add 5 μl of 3 mM stock solution per 500 ml of medium., L-ascorbic acid 2-phosphate (Sigma A8960) (50 μg/ml final concentration), BSA (100× Fraction V 7.5% Solution Gibco 15260-037-0.16 ml per 500 ml media bottle. Cell were stained for alkaline phosphatase stem cell marker (AP), and were found positive as shown for the representative images of pluripotent cell colonies at P18-20 in the selected conditions shown.

Figure 6A:
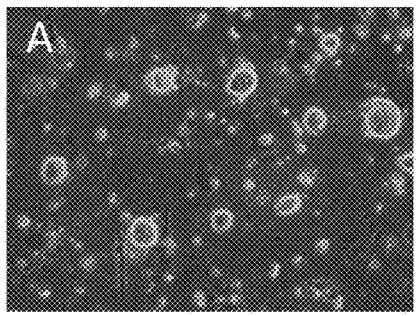
Figure 6B:
Figure 6C:
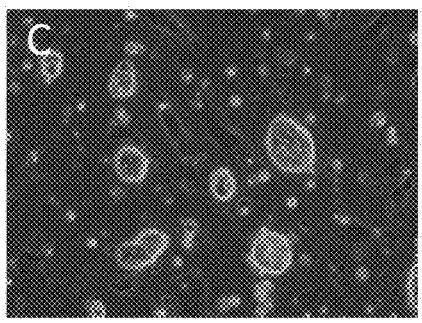
Figure 6D:
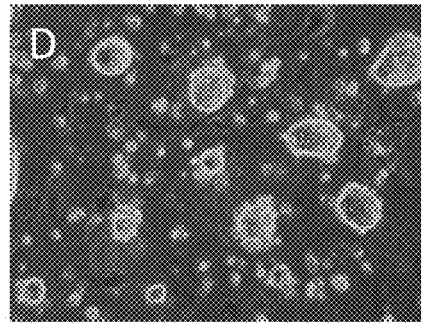
Figure 6E:
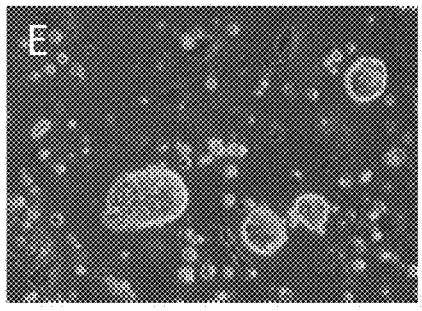
Figure 6F:
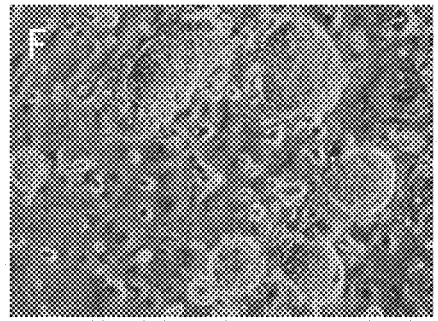

FIGS. 6A, 6B, 6C, 6D, 6E and 6F are images of human naïve ESCs/iPSCs which were expanded under particular conditions without L-glutamine. FIG. 6A—conditions 1; FIG. 6B—conditions 2; FIG. 6C—conditions 3; FIG. 6D—conditions 4; FIG. 6E—conditions 9; FIG. 6F—conditions 11. FX71 human iPSC line was expanded on Gelatin/DR4 feeder cell coated plates in 5% O2 with the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), NEAA—5 ml (Biological Industries 01-340-1B), 50 μL of 50 mM stock Beta-mercaptoethanol (1 vile), 5 ml B27 supplement (Invitrogen 17504-044), Insulin (Sigma I-1882)—12.5 microg/ml insulin), Apo-transferrin (Sigma T-1147), 100 μg/ml final concentration, Progesterone (Sigma P8783), 0.02 μg/ml final concentration, Putrescine (SigmaP5780), 16 μg/ml final concentration, Sodium selenite (Sigma S5261), add 5 μl of 3 mM stock solution per 500 ml of medium, L-ascorbic acid 2-phosphate (Sigma A8960) (50 μg/ml final concentration), BSA (100× Fraction V 7.5% Solution Gibco 15260-037-0.16 ml per 500 ml media bottle. Representative images of cells in the different WIS-NHSM conditions are shown, indicating expansion of colonies without exogenous L-glutamine supplementation in these conditions.

Figure 7:
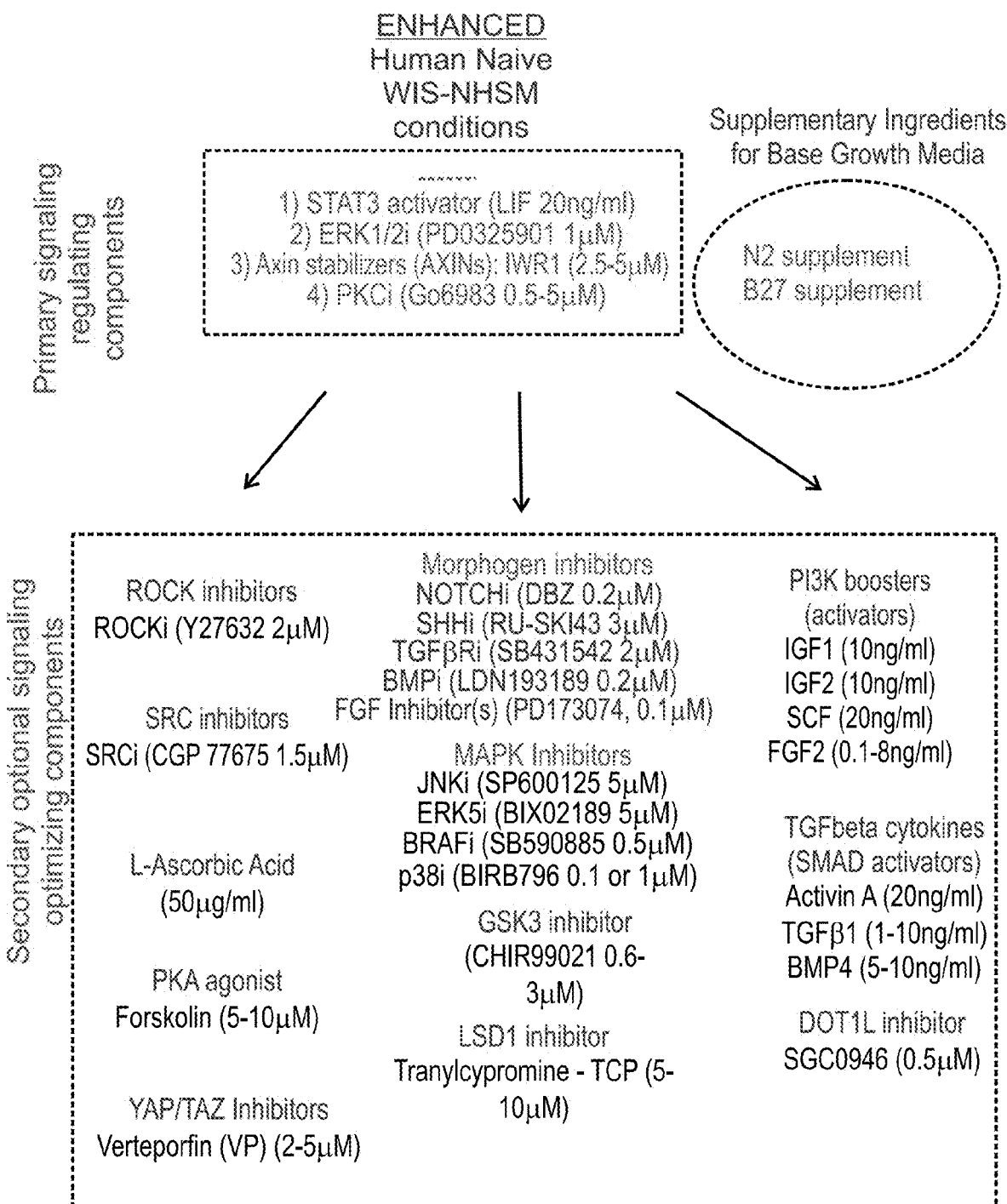

FIG. 7 is a schematic illustration depicting a strategy for designing the WIS-NHSM conditions, and includes non-limiting examples of small molecules and concentration ranges thereof.

FIG. 8 depicts the supplements of different WIS-NHSM examples (conditions 41-60) tested for human naïve iPSCs and ESC derivation and maintenance. The base media used is described in Example 5 below.

FIG. 9 depicts the supplements of different WIS-NHSM examples tested (conditions 61-80) for human naïve iPSCs and ESC derivation and maintenance. The base media used is described in Example 5 below.

FIG. 10 depicts the supplements of different WIS-NHSM examples tested (conditions 81-99) for human naïve iPSCs and ESC derivation and maintenance. The base media used is described in Example 5 below.

FIG. 11 depicts the supplements of different WIS-NHSM examples tested (conditions 100-119) for human naïve iPSCs and ESC derivation and maintenance. The base media used is described in Example 5 below.

FIG. 12 depicts the supplements of different WIS-NHSM examples tested (conditions 120-131) for human naïve iPSCs and ESC derivation and maintenance. The base media used is described in Example 5 below.

Figure 13:
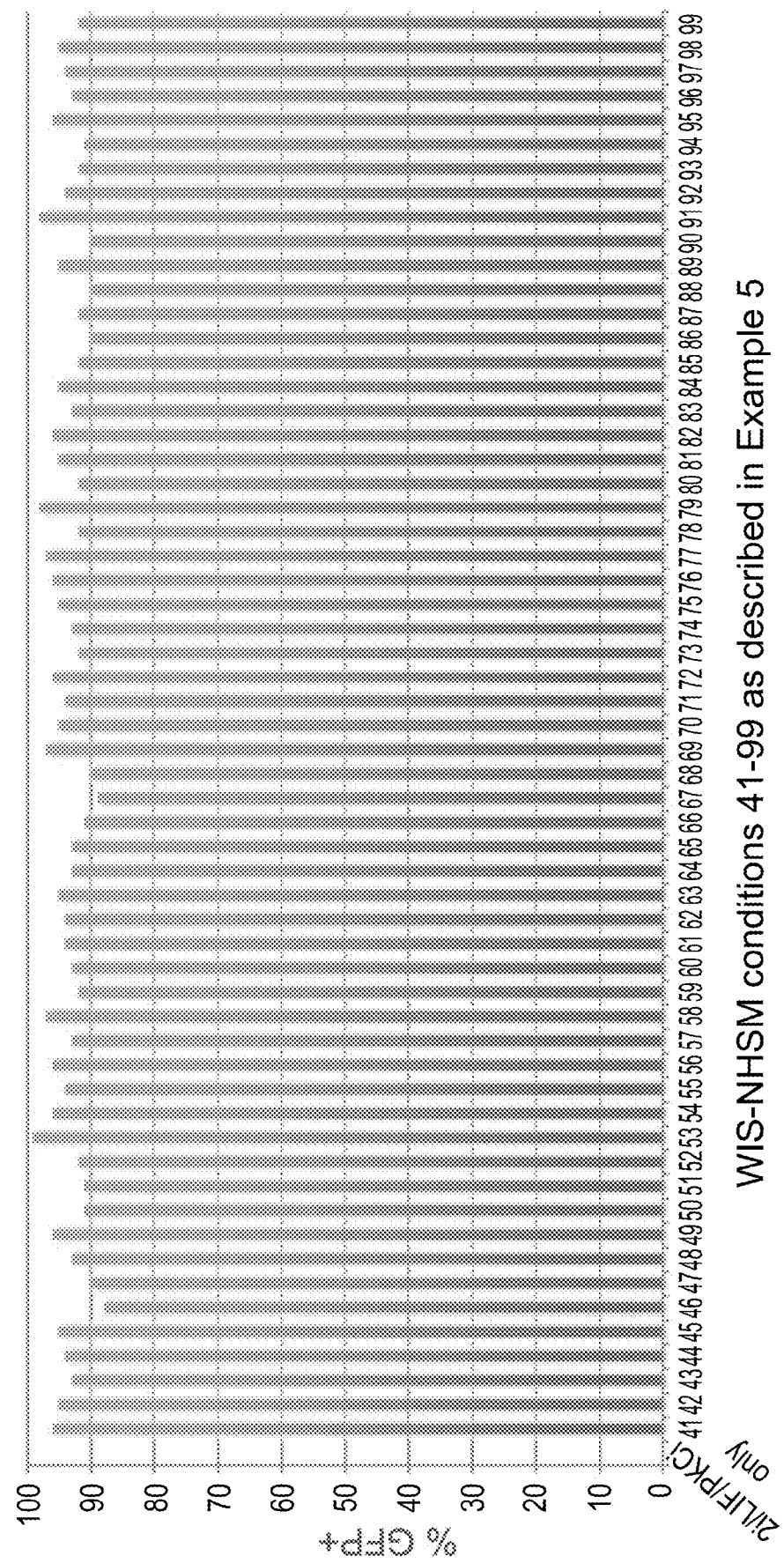

FIG. 13 is a graph illustrating FACS analysis of WIBR3 hESC line carrying deltaPEOct4-GFP reporter (described in Gafni et al. Nature 2013). The cells were expanded on Gelatin/DR4 feeders coated plates in 5% O2 with the indicated supplements of conditions 41-99 (described in Example 5, hereinbelow) to the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 μL of 50 mM stock Beta-mercaptoethanol (1 vile), 10 ml B27 supplement (Invitrogen 17504-044), Insulin (Sigma I-1882)—add 6.25 mg insulin per 1 bottle to give approximately additional 12.5 microg/ml insulin), Apo-transferrin (Sigma T-1147), 100 μg/ml final concentration, Progesterone (Sigma P8783), 0.02 μg/ml final concentration, Putrescine (Sigma P5780), 16 μg/ml final concentration, Sodium selenite (Sigma S5261), add 5 μl of 3 mM stock solution per 500 ml of medium, BSA (100× Fraction V 7.5% Solution Gibco 15260-037—add 0.16 ml per 500 ml media bottle. The cells were expanded for 28 days (total of 6 passages) passages and evaluated by FACS analysis for OCT4-GFP+ reporter. The results show the cells maintain their pluripotency in the conditions described. 2i/LIF/PKCi (5 microM) conditions were used as negative controls, as the cells lose their pluripotency in these conditions.

Figure 14:
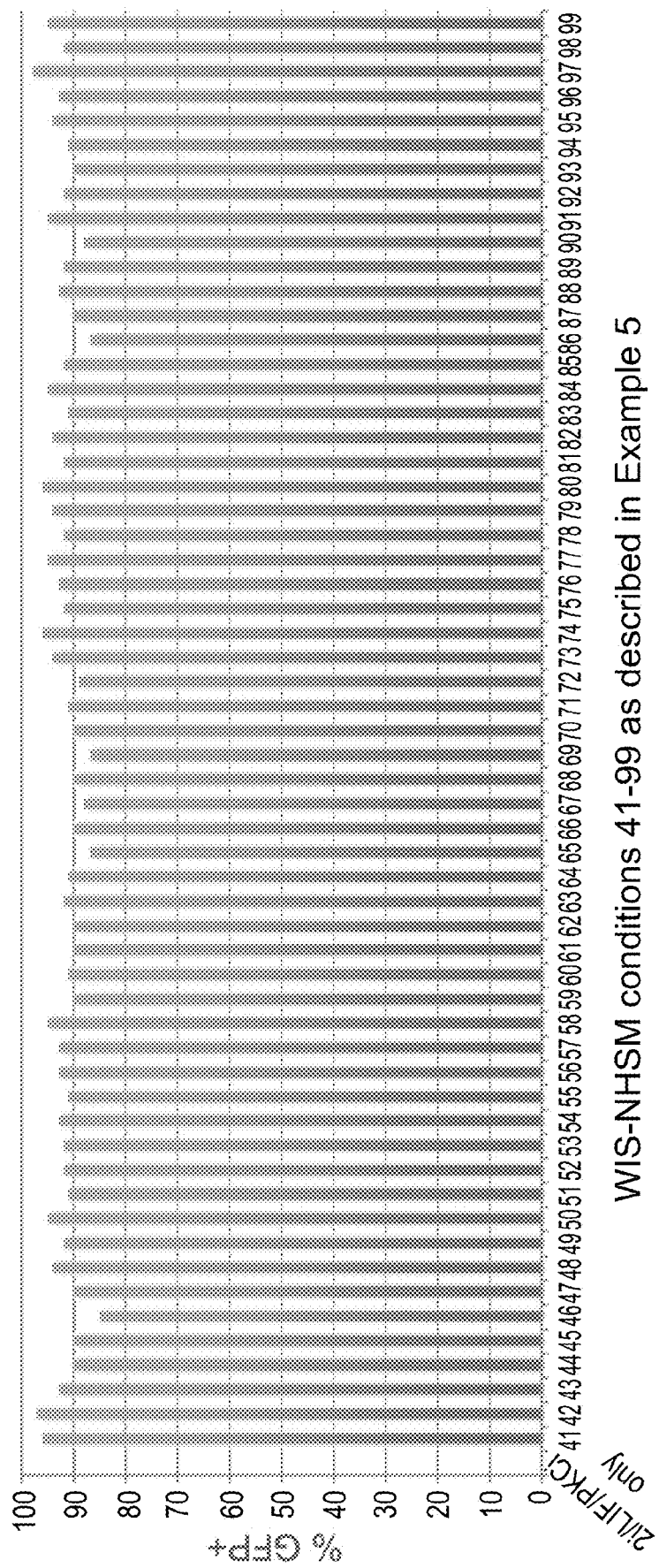

FIG. 14 is a graph illustrating FACS analysis of WIBR3 hESC line carrying deltaPEOct4-GFP reporter (described in Gafni et al. Nature 2013). The cells were expanded on LAMININ-521 coated plates (BIOLAMINA INC.—Catalogue number:www(dot)biolamina(dot)com/product-ln-521) in 5% O2, with the indicated supplements of conditions 41-99 (described in Example 5, hereinbelow) to the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 μL of 50 mM stock Beta-mercaptoethanol (1 vile), 10 ml B27 supplement (Invitrogen 17504-044), Insulin (Sigma I-1882)—add 6.25 mg insulin per 1 bottle to give approximately additional 12.5 microg/ml insulin), Apo-transferrin (Sigma T-1147), 100 μg/ml final concentration, Progesterone (Sigma P8783), 0.02 μg/ml final concentration, Putrescine (SigmaP5780), 16 μg/ml final concentration, Sodium selenite (Sigma S5261), add 5 μl of 3 mM stock solution per 500 ml of medium, BSA (100× Fraction V 7.5% Solution Gibco 15260-037—add 0.16 ml per 500 ml media bottle. The cells were expanded for 28 days (total of 6 passages) passages and evaluated by FACS analysis for OCT4-GFP+ reporter. The results show the cells maintain their pluripotency in the conditions described. 2i/LIF/PKCi (5 microM) conditions were used as negative controls, as the cells lose their pluripotency in these conditions.

Figure 15:
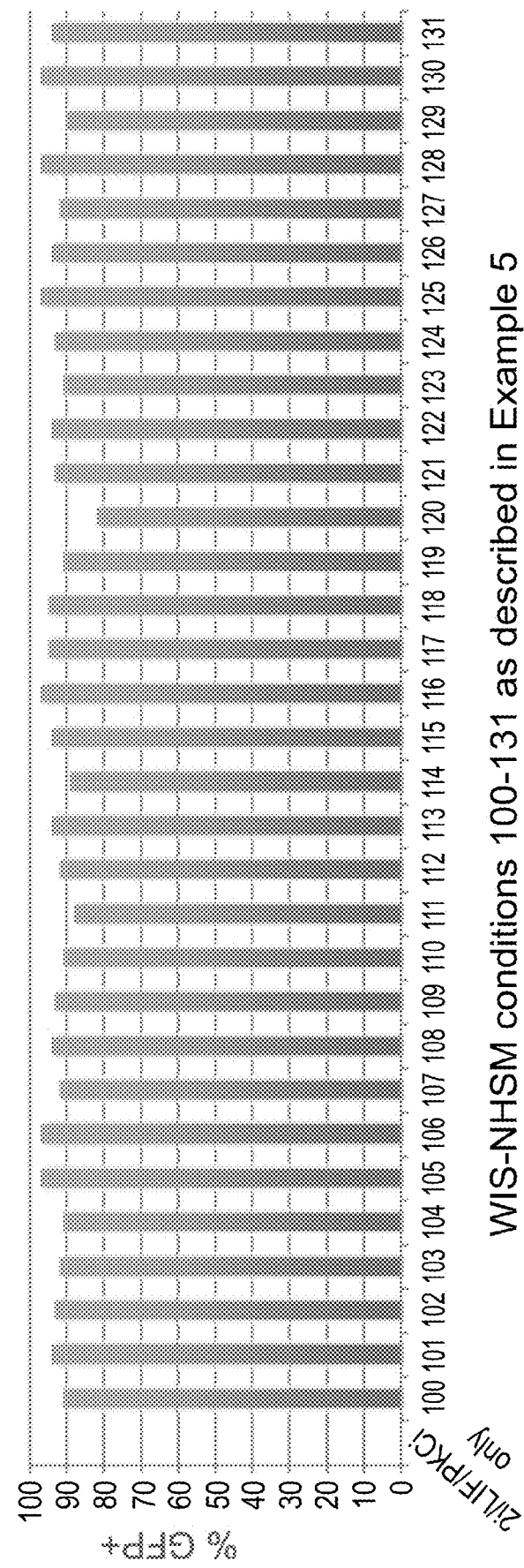

FIG. 15 is a graph illustrating FACS analysis of WIBR3 hESC line carrying deltaPEOct4-GFP reporter (described in Gafni et al. Nature 2013). The cells were expanded on Gelatin/DR4 feeders coated plates in 5% O2 with the indicated supplements of conditions 100-131 (described in Example 5, hereinbelow) to the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 μL of 50 mM stock Beta-mercaptoethanol (1 vile), 10 ml B27 supplement (Invitrogen 17504-044), Insulin (Sigma I-1882)—add 6.25 mg insulin per 1 bottle to give approximately additional 12.5 microg/ml insulin), Apo-transferrin (Sigma T-1147), 100 µg/ml final concentration, Progesterone (Sigma P8783), 0.02 µg/ml final concentration, Putrescine (Sigma P5780), 16 µg/ml final concentration, Sodium selenite (Sigma S5261), add 5 µl of 3 mM stock solution per 500 ml of medium, BSA (100× Fraction V 7.5% Solution Gibco 15260-037—add 0.16 ml per 500 ml media bottle. The cells were expanded for 28 days (total of 6 passages) passages and evaluated by FACS analysis for OCT4-GFP+ reporter. The results show the cells maintain their pluripotency in the conditions described. 2i/LIF/PKCi (5 microM) conditions were used as negative controls, as the cells lose their pluripotency in these conditions.

Figure 16:
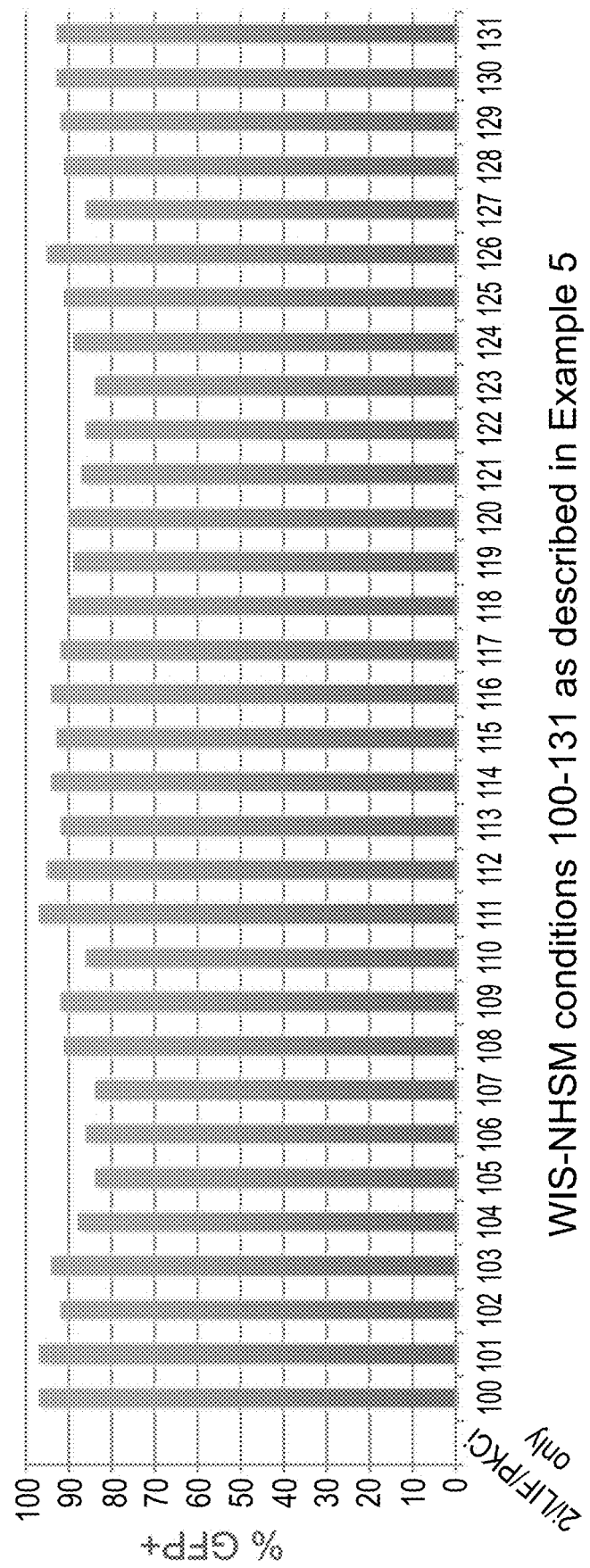

FIG. 16 is a graph illustrating FACS analysis of WIBR3 hESC line carrying deltaPEOct4-GFP reporter (described in Gafni et al. Nature 2013), was expanded on LAMININ-521 coated plates (BIOLAMINA INC.—Catalogue number: www(dot)biolamina(dot)com/product-ln-521) in 5% O2, with the indicated supplements of conditions 100-131 (described in Example 5, hereinbelow) to the following base medium: 1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 µL of 50 mM stock Beta-mercaptoethanol (1 vile), 10 ml B27 supplement (Invitrogen 17504-044), Insulin (Sigma I-1882)—add 6.25 mg insulin per 1 bottle to give approximately additional 12.5 microg/ml insulin), Apo-transferrin (Sigma T-1147), 100 µg/ml final concentration, Progesterone (Sigma P8783), 0.02 µg/ml final concentration, Putrescine (SigmaP5780), 16 µg/ml final concentration, Sodium selenite (Sigma S5261), add 5 µl of 3 mM stock solution per 500 ml of medium, BSA (100× Fraction V 7.5% Solution Gibco 15260-037—add 0.16 ml per 500 ml media bottle. The cells were expanded for 28 days (total of 6 passages) passages and evaluated by FACS analysis for OCT4-GFP+ reporter. The results show the cells maintain their pluripotency in the conditions described. 2i/LIF/PKCi (5 microM) conditions were used as negative controls, as the cells lose their pluripotency in these conditions.

Figure 17A:
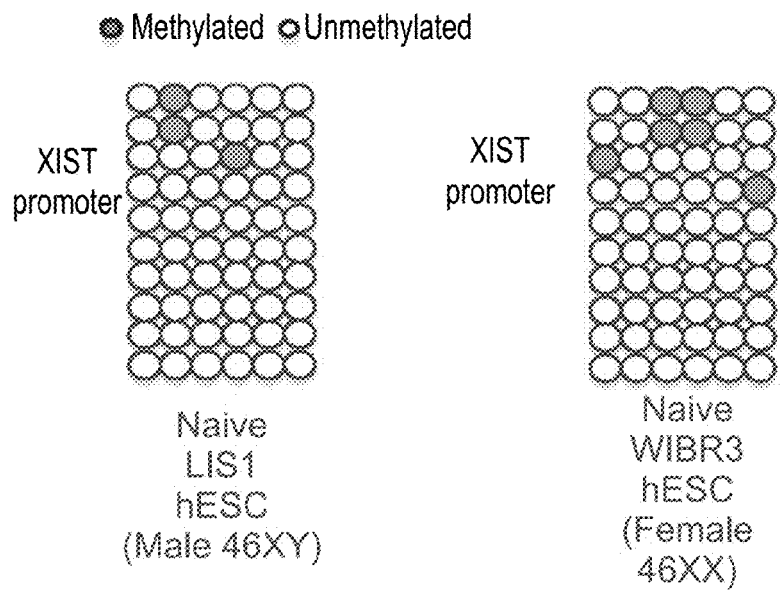
Figure 17B:
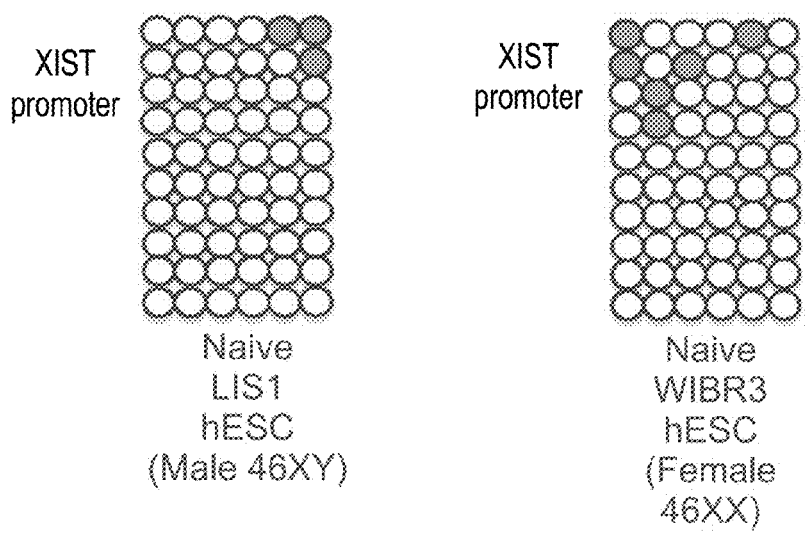
Figure 17C:
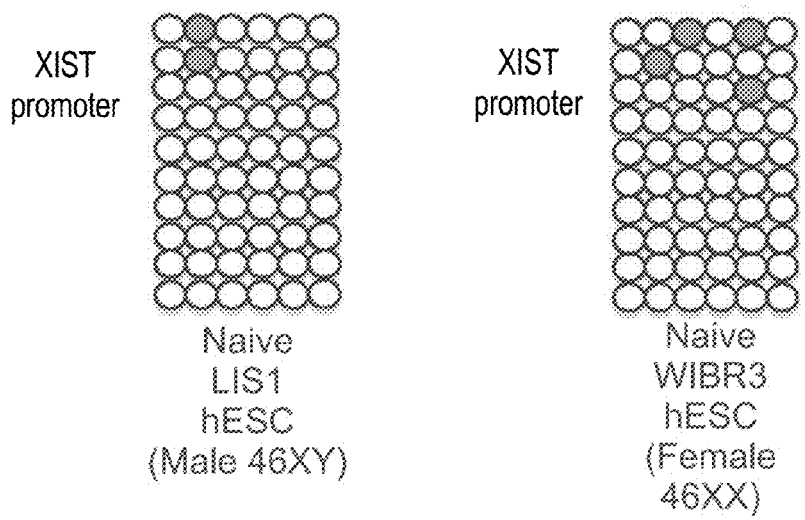

FIGS. 17A-F depict bisulfite sequencing analyses of the XIST promoter. Shown are bisulfite-sequencing analyses of six CpG sites in single clones of an XIST promoter amplicon. Filled circles=methylated CpG sites; Empty circles=Unmethylated CpG sites. For naïve PSCs, the cells were expanded in the indicated culture media (FIGS. 17A-E) for 14 days on DR4 irradiate MEF cells and 0.2% gelatin coated plates in 5% O2 conditions at 37 C. All culture media included L-ascorbic acid (at a final concentration of 50 µg/ml). For non-naïve conditions (primed PSCs), the cells were cultured in mTESR1 (Stem Cell Technologies—catalogue number 05850) on Matrigel coated plates. FIG. 17A—culture medium included: Srci 1 µM, ERK1/2i 1 µM, LIF 20 ng/ml; FIG. 17B—culture medium included: AXINs 5 µM, ERK1/2i 1 µM, LIF 20 ng/ml; FIG. 17C—culture medium included: AXINs 5 µM, ERK1/2i 1 µM, LIF 20 ng/ml, PKCi 4 µM, GSK3i 1.5 µM; FIG. 17D—culture medium included: AXINs 5 µM, ERK1/2i 1 µM, LIF 20 ng/ml, PKCi 4 µM, GSK3i 1.5 µM, P38i 2 µM, and JNKi 5 µM. FIG. 17E—culture medium included: AXINs 5 µM, ERK1/2i 1 µM, LIF 20 ng/ml, PKCi 4 µM, GSK3i 1.5 µM, P38i 2 µM, JNKi 5 µM, and SRCi 1 µM. Key for small molecule abbreviation: LIF (20 ng/ml), ERK1/2i (PD0325901 1 µM), AXINs (IWR1 5 µM), PKCi (Go6983 4 µM), GSK3βi (CHIR99021 1.5 µM), P38i (BIRB796 2 µM), JNKi (SP600125 5 µM), SRCi (CGP77675 1 µM). Note that in naïve PSCs both alleles are demethylated (unmethylated) (FIGS. 17A-E, female cells). In contrast, note that in non-naïve (i.e., primed PSCs) the XIST promoter is completely methylated in the male cells, and methylated on one allele of the female cells (FIG. 17F). These results conclusively demonstrate that male and female Naive hESCs/iPSCs retain a unique pre-X inactivation state under various WIS-NHSM conditions.

Figure 18:
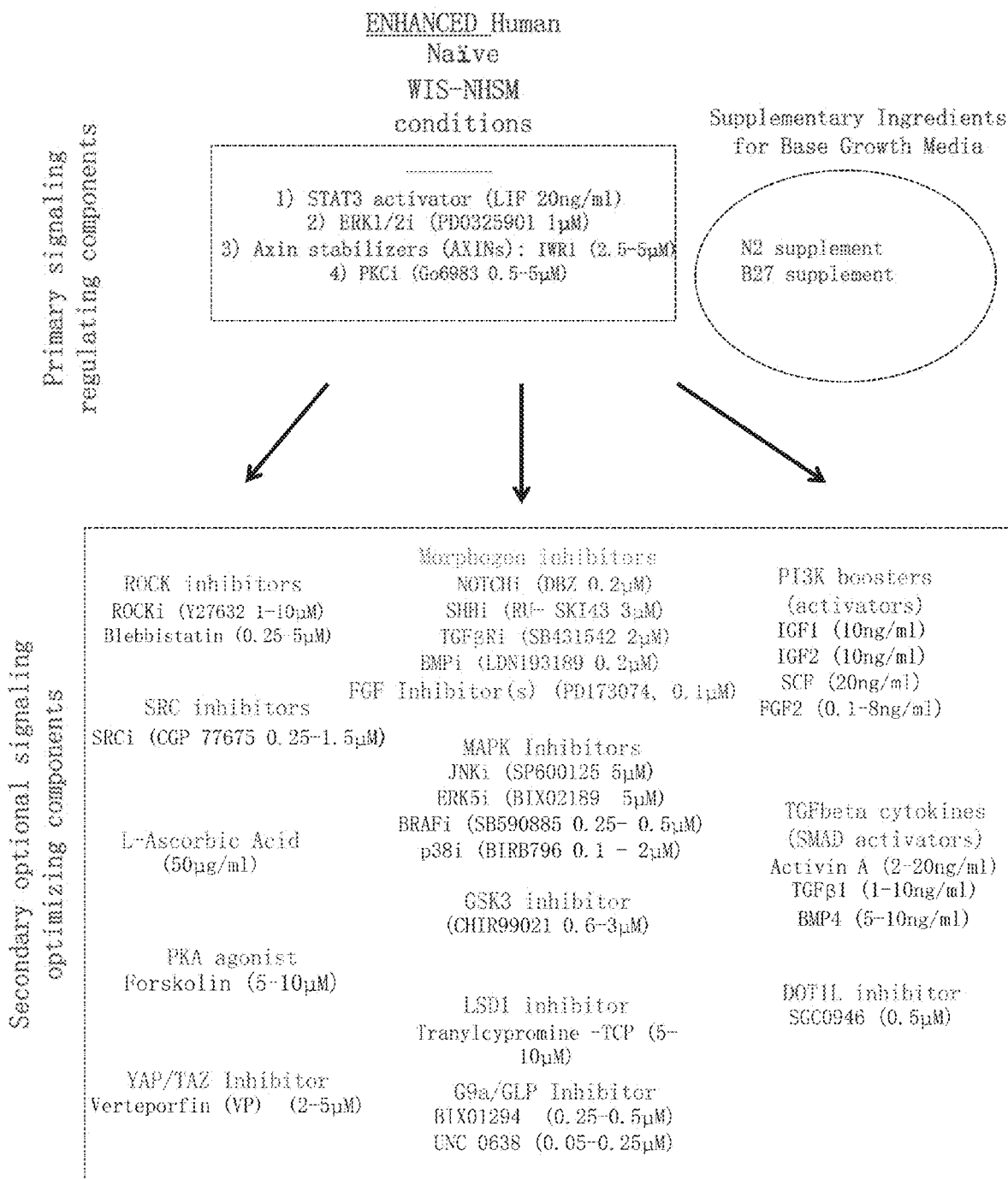

FIG. 18 is a scheme presenting strategy for maintaining pluripotent stem cells in a naïve state, and includes examples of small molecules and concentration ranges for a culture medium according to some embodiments of the invention.

FIG. 19 provides non-limiting examples of the culture medium of some embodiments of the invention, which is capable of maintaining human naïve PSC in a naïve and undifferentiated state, and for ESC derivation. The base medium is described in Example 6 hereinbelow.

Figure 20:
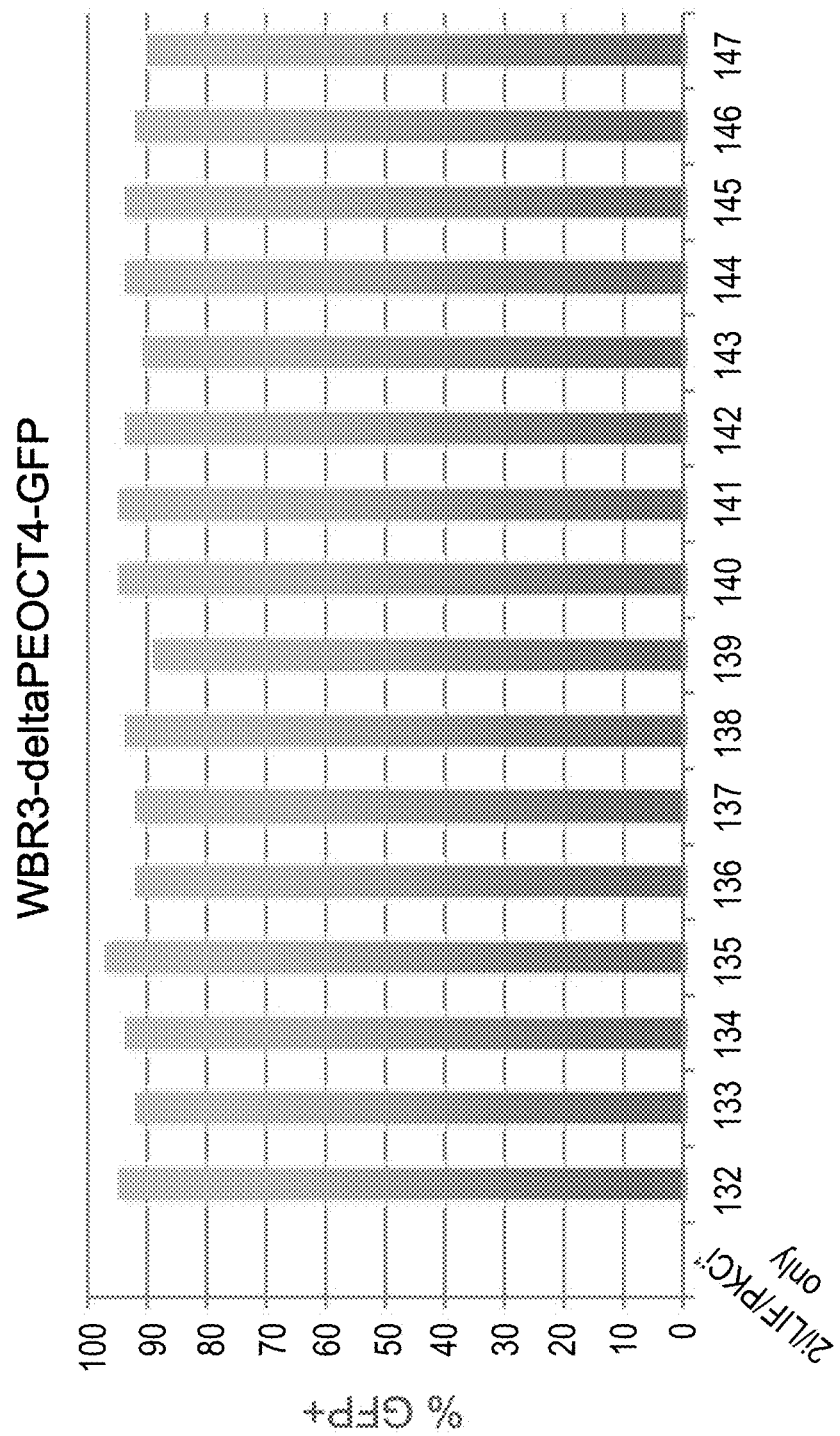

FIG. 20 is a histogram depicting the percentage of GFP-positive cells ("GFP+") when cultured in the culture medium of some embodiments of the invention (media 132-147, described in Example 6 hereinbelow and in FIG. 19). WIBR3 hESC line carrying Oct4-GFP reporter (described in Gafni et al. Nature 2013), was expanded on Gelatin/DR4 irradiated MEF coated plates in 5% O2 with the base medium described in Example 6 of the Examples section below, wherein the base medium used for these experiments included also L-ascorbic acid 2-phosphate (Sigma A8960) (50 µg/ml final concentration). The cells were expanded for up to 23 passages and evaluated by FACS analysis for OCT4-GFP+ reporter. The results show the cells maintain their pluripotency in the conditions described. 2i/LIF/PKCi (5 microM) conditions were used as negative controls, as the cells lose their pluripotency in these conditions.

Figure 21:
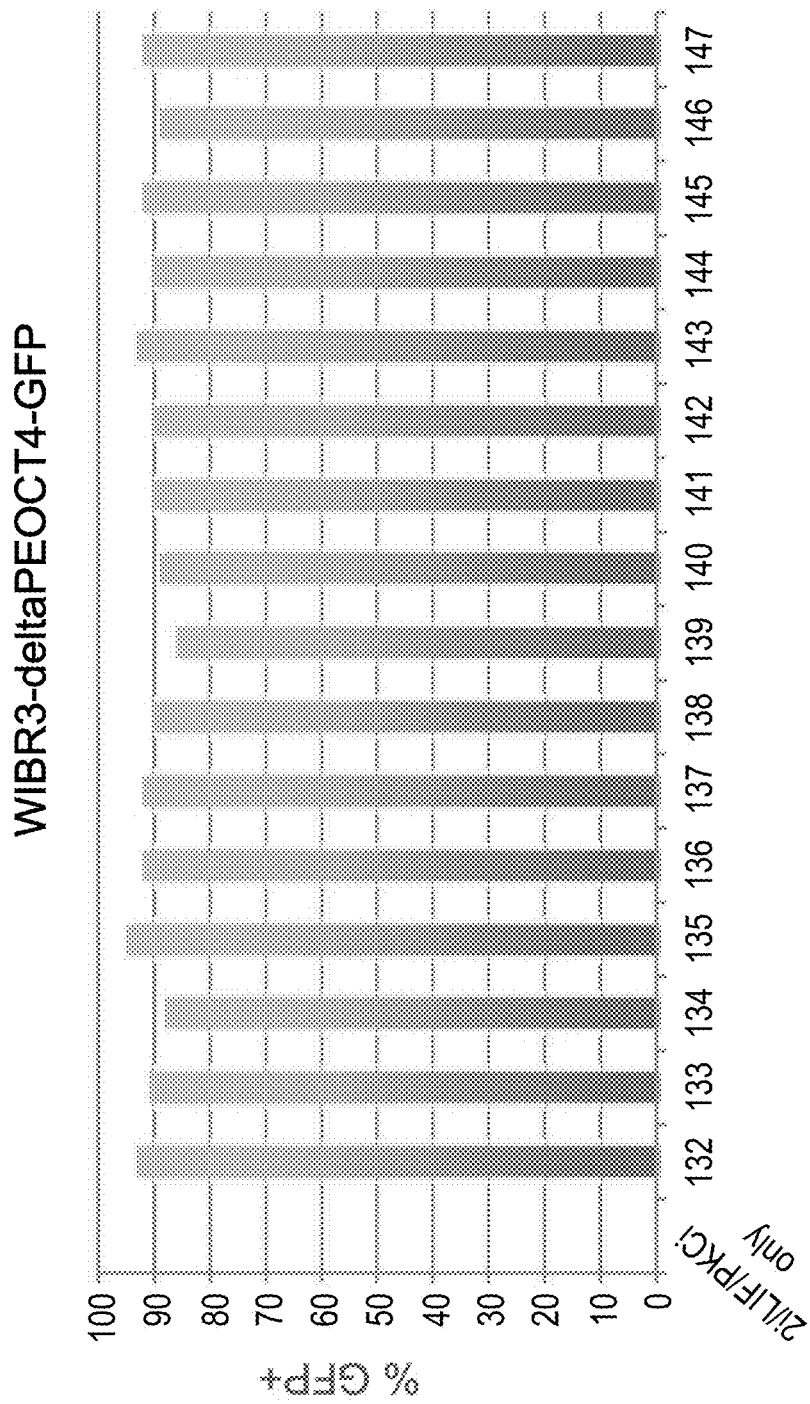

FIG. 21 is a histogram depicting the percentage of GFP-positive cells ("GFP+") when cultured in the culture medium of some embodiments of the invention (media 132-147, described in Example 6 hereinbelow and in FIG. 19). WIBR3 hESC line carrying deltaPEOct4-GFP reporter (described in Gafni et al. Nature 2013), was expanded on Matrigel coated plates in 5% O2 with the base medium described in Example 6 of the Examples section below, wherein the base medium used for these experiments included also L-ascorbic acid 2-phosphate (Sigma A8960) (50 µg/ml final concentration). The cells were expanded for up to 23 passages and evaluated by FACS analysis for OCT4-GFP+ reporter. The results show the cells maintain their pluripotency in the conditions described. 2i/LIF/PKCi (5 microM) conditions were used as negative controls, as the cells lose their pluripotency in these conditions.

Figures 22A, 22B:
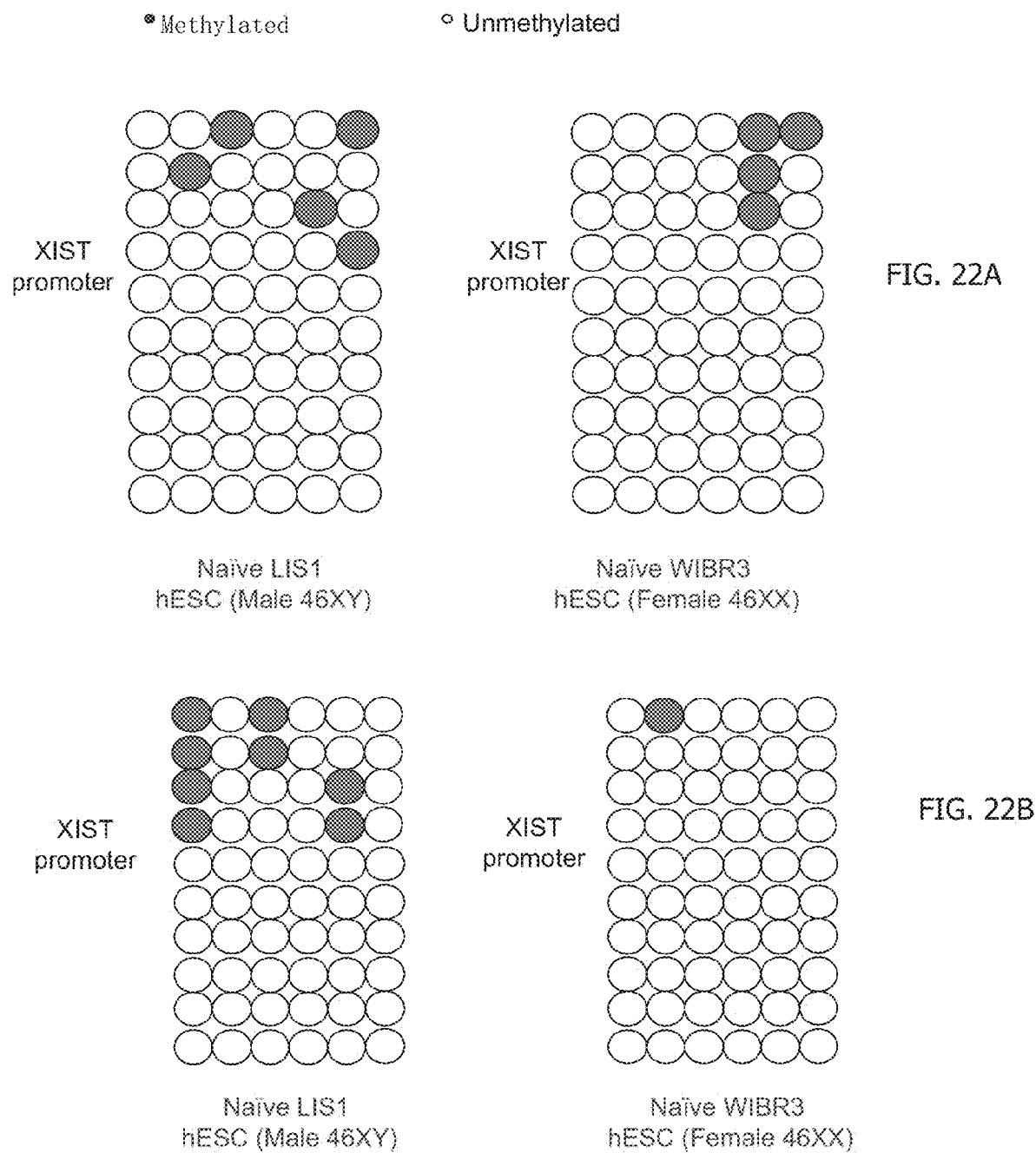
Figure 22C:
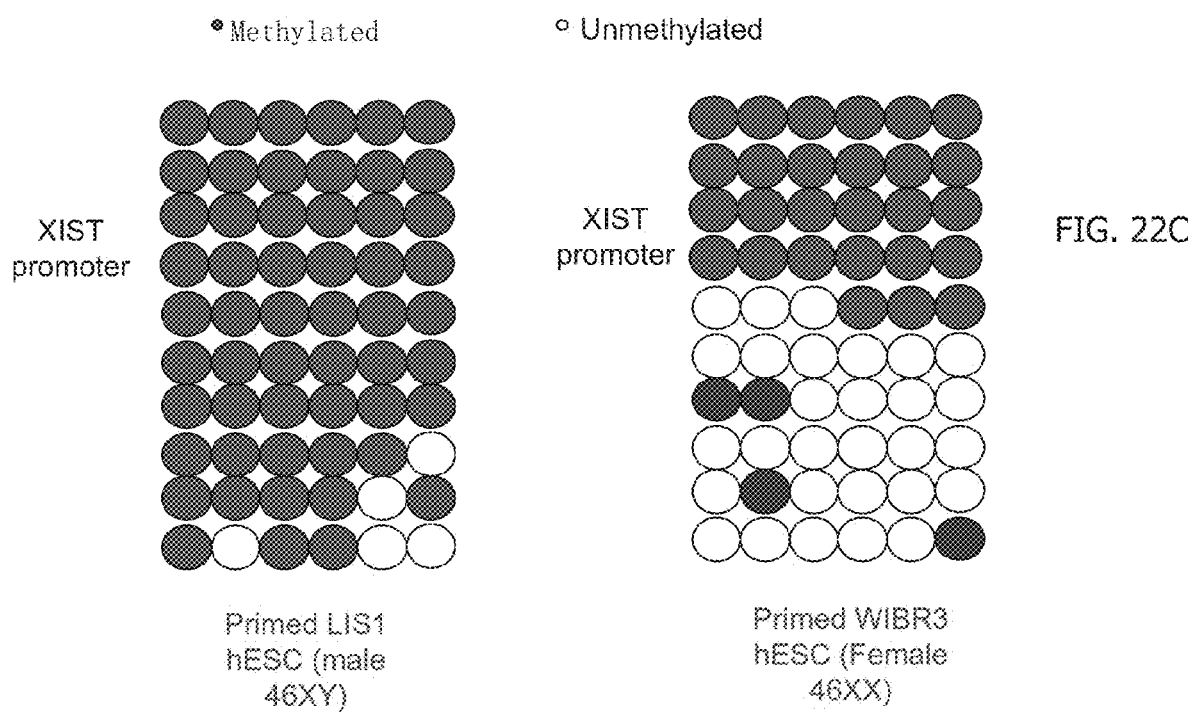

FIGS. 22A-C show the results of a bisulfite sequence analysis demonstrating that the male and female naïve hESCs or iPSCs retain a unique pre-X inactivation state in WIS-NHSM conditions (the medium of some embodiments of the invention). Filled circles=methylated CpG sites; Empty circles=Unmethylated CpG sites. Shown are bisulfite sequencing analyses of six CpG sites in single clones of an XIST promoter amplicon. Note that in naive cells both alleles are demethylated. The cells were expanded in the indicated culture conditions for 14 days on DR4 irradiate MEF cells and 0.2% gelatin coated plates in 5% O2 conditions at 37° C. All culture media included L-ascorbic acid (50 µg/ml). FIG. 22A—culture medium included: AXINs 5 µM, ERK1/2i 1 µM, LIF 20 ng/ml, PKCi 2 µM, GSK3i 1.5 µM, P38i 0.25 µM, JNKi 5 µM, SRCi 0.5 µM. FIG. 22B—culture medium included: AXINs 5 µM, ERK1/2i 1 µM, LIF 20 ng/ml, PKCi 2 µM, GSK3i 1.5 µM, P38i 0.25 µM, JNKi 5 µM, SRCi 0.5 µM, and G9ai 0.5 µM. Key for small molecule abbreviation: LIF (20 ng/ml), ERK1/2i (PD0325901, 1 µM), AXINs (IWR1, 5 µM), PKCi (Go6983, 2 µM), GSK3βi (CHIR99021, 1.5 µM), P38i (BIRB796, 0.25 µM), JNKi (SP600125, 5 µM), SRCi (CGP77675, 0.5 µM), and G9ai (BIX01294, 0.5 µM). FIG. 22C—non-naïve conditions (primed PSCs) included culturing the cells in mTESR1 (Stem Cell Technologies—catalogue number 05850) on Matrigel coated plates. Note that in naïve PSCs both alleles of female cells are demethylated (unmethylated) (FIGS. 22A-B, right panels showing female cells). In contrast, note that in non-naïve (i.e., primed PSCs) the XIST promoter is completely methylated in the male cells (FIG. 22C, left panel, male cell), and methylated on one allele of the female cells (FIG. 22C, right panel, female cell). These results conclusively demonstrate that male and female Naive hESCs/iPSCs retain a unique pre-X inactivation state under various culture medium of some embodiments of the invention.

FIGS. 23A-D depict the generation of the LIS 38 tg-pTrip lck EGFP hTP53 crispr. FIG. 23A—Shown are the sequences of the wild type LIS38 (SEQ ID NO:195) and of the Crispr_C2 (SEQ ID NO:196). The sequence alignment between the two sequences (SEQ ID NOs: 134 and 135) demonstrates the deletion of part of Exon 3 of TP53 via CRISPR/CAS9-sgRNA targeted region. FIG. 23B—Western Immunoblot showing loss of WT p53 protein in the LIS38 tg-pTrip lck EGFP p53 crispr targeted cells (right lane) as compared to the WT parental cell line (left lane). FIG. 23C—Karyotype analysis of the LIS38 tg-pTrip lck EGFP p53 crispr cells, indicating 46XY normal karyotype. FIG. 23D—Representative images of the LIS38 tg-pTrip lck EGFP p53 crispr cells. Left: Bright field image; Right: Dark field images showing GFP fluorescence positive signal. This indicates that the cell line is constitutively labeled with GFP fluorescent protein, which enables tracking of this cell line derived cells in host tissues after micro-injection. In summary, these results describe a method to generate human naïve PSC lines depleted for P53 protein, in this case via CRISPR/CAS9 sgRNA mediated targeting, and subsequently labeling the cells with constitutively expressed fluorescent protein. These cells can be injected into host embryos to generate chimeric embryos.

Figure 24B:
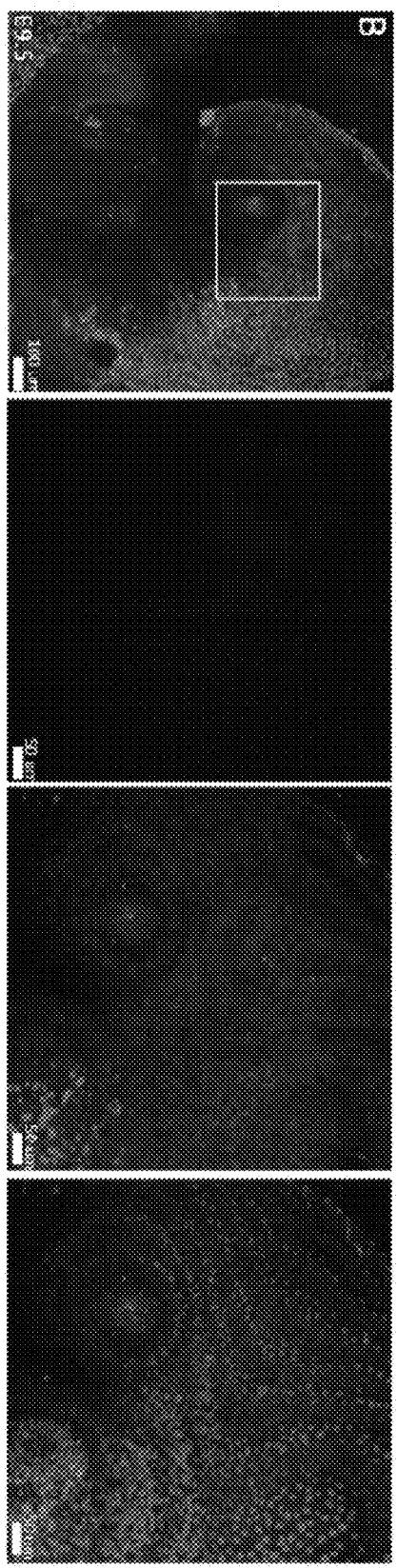
Figure 24A:
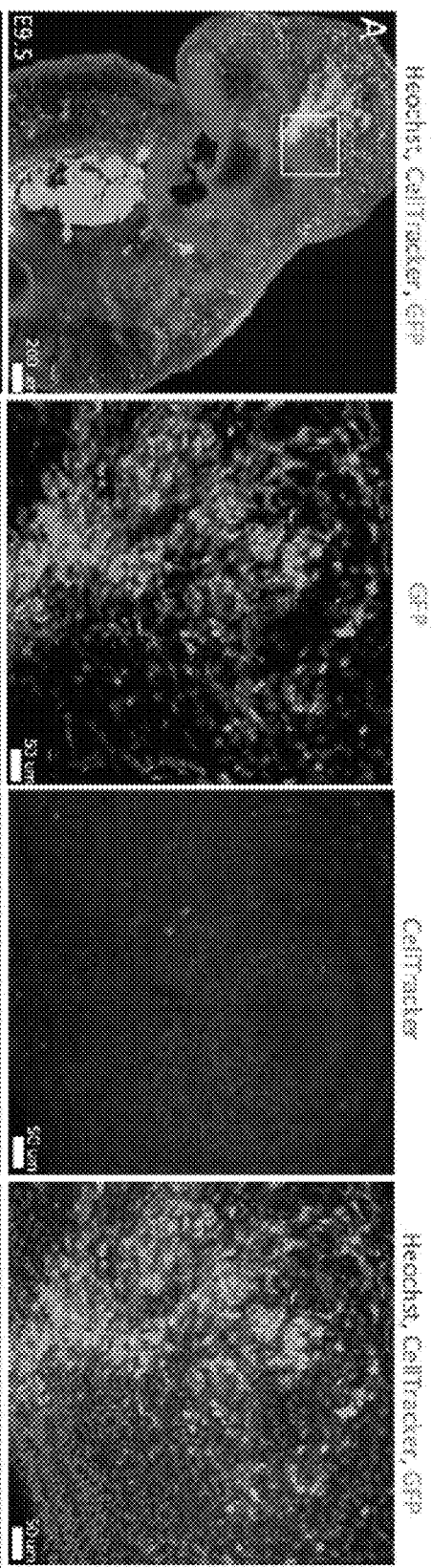

FIGS. 24A-B show that microinjection of LIS 38 EGFP hTP53 C2 naive human iPS cells into mouse morulas generates cross-species chimaeric humanized mice with high contribution and chimerism levels. FIG. 24A—mouse embryos injected with the LIS 38 EGFP hTP53 naive human iPS cells. FIG. 24B—non-injected mouse embryos using the same analysis. Shown are representative images demonstrating widespread integration of GFP-labeled human naive iPS-derived cells into different locations of an E9.5 mouse embryo. Hoechst and CellTracker were used for counterstaining. The first column shows the whole embryo. The $2^{nd}$-$4^{th}$ columns (from the left) show a zoom in images focusing on the head region (white squares in the images of the first column). FIG. 24A shows an injected embryo, where the human iPS-derived cells (GFP-positive cells) integrated into a large portion of superficial cranial tissues. FIG. 24B shows a control embryo that was not injected with human naive iPS-derived cells; there are no GFP positive cells detected in this control embryo.

Figure 25A:
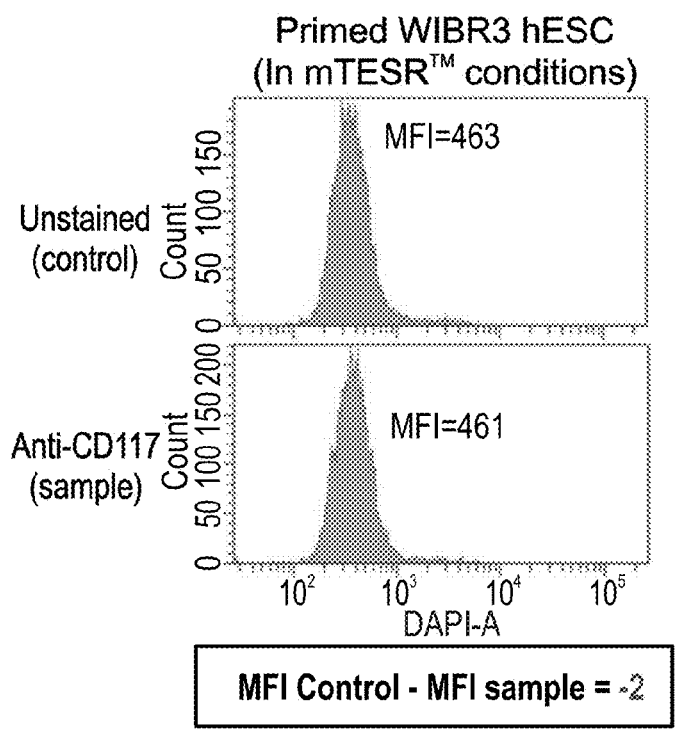
Figure 25B:
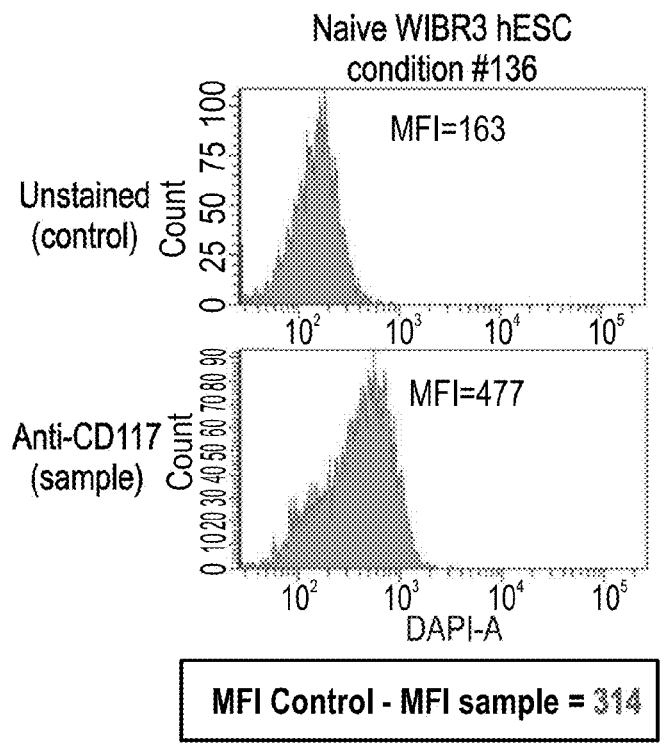
Figure 25C:
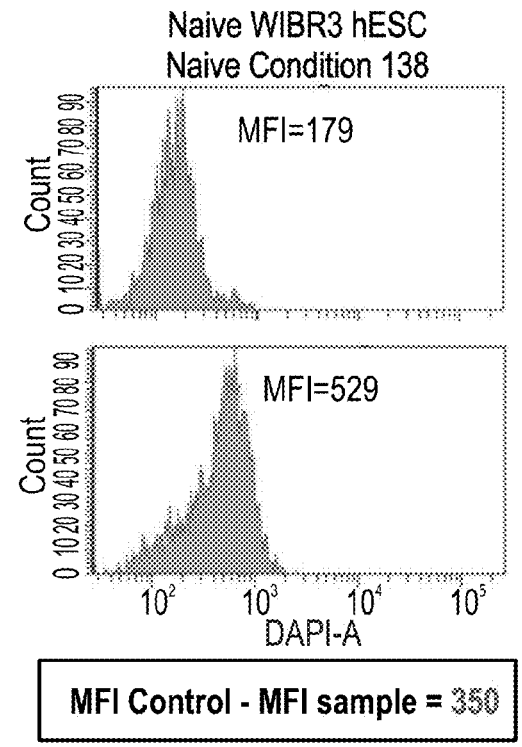

FIGS. 25A-C depict FACS analyses of WIBR3 hESCs primed or naïve PSC for expression of the C-KIT (CD117) cell surface protein. WIBR3 hESCs, grown under conditions for primed PSC (as described below) or under "naïve" conditions (in medium 136 or 138) and were then dissociated to a single-cell suspension using 0.05% trypsin-EDTA.

For labeling of cell surface antigens, cells were incubated with primary antibody (Brilliant Violent 421-conjugated mouse anti-human CD117 (C-KIT) IgG, BD catalog #: 562434, dilution 1:200) or remained unstained (control) in ice-cold FACS buffer (2% (vol/vol) Fetal bovine serum (FBS) in PBS) for 30 minutes and followed by washing twice. Then cell labeling was analyzed using the flow cytometer FACSAria II with FACSDiva software version 6.1.3 (BD Biosciences). MFI=Mean fluorescence intensity. Note that while the primed PSC do not express C-KIT (i.e., they are CD117-negative) (FIG. 25A), the naive PSC express C-KIT (i.e., they are CD117-positive) (FIGS. 25B and 25C). These results support the conclusion that C-KIT is a novel marker for human naïve, but not primed, PSCs.

Figure 26A:
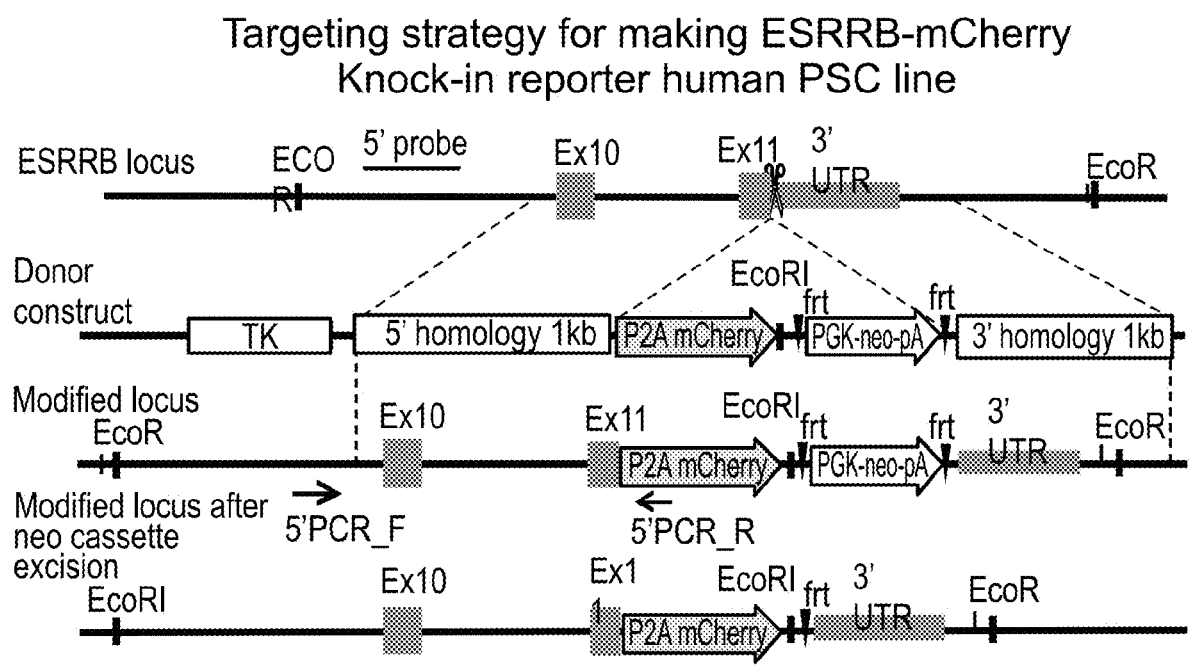
Figure 26B:
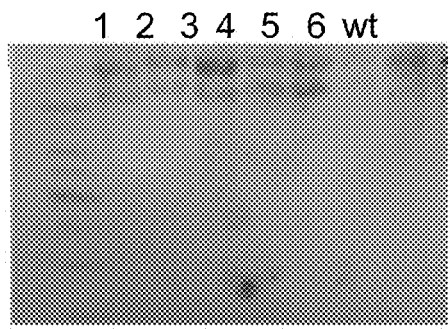
Figure 26C:
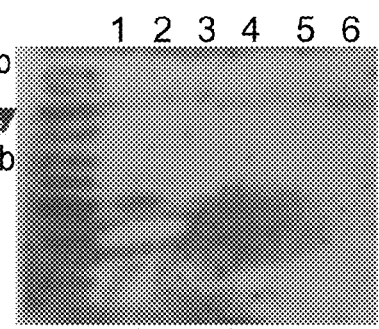
Figure 26D:
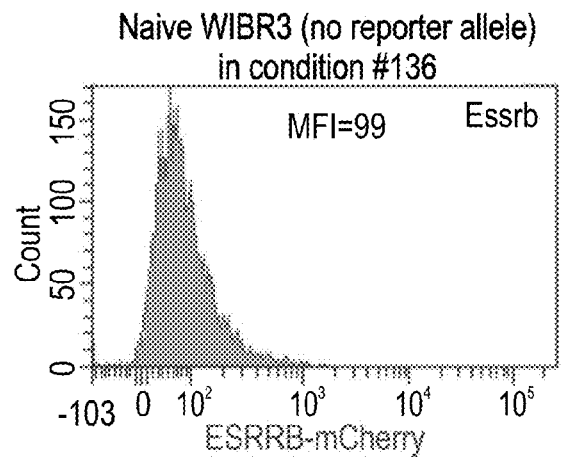
Figure 26G:
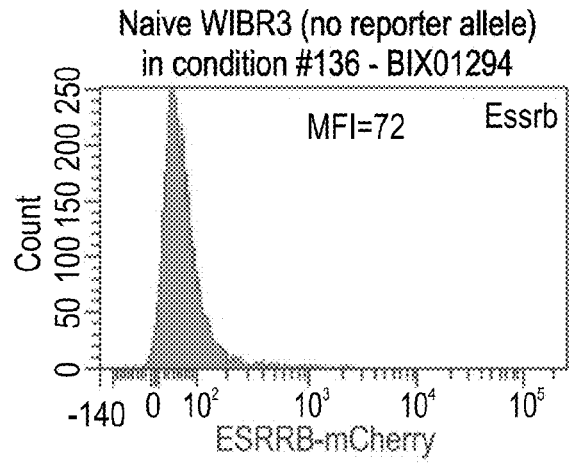
Figure 26E:
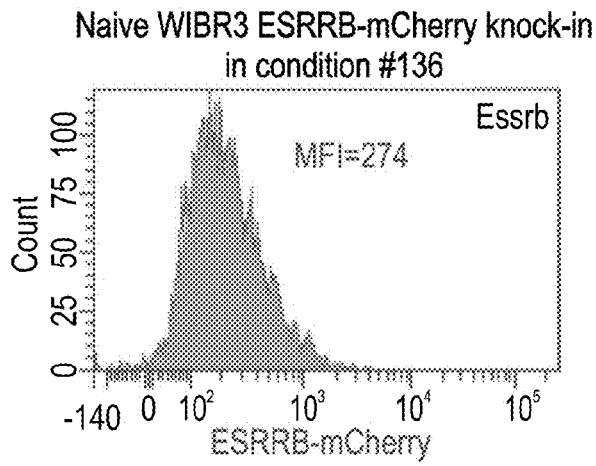
Figure 26H:
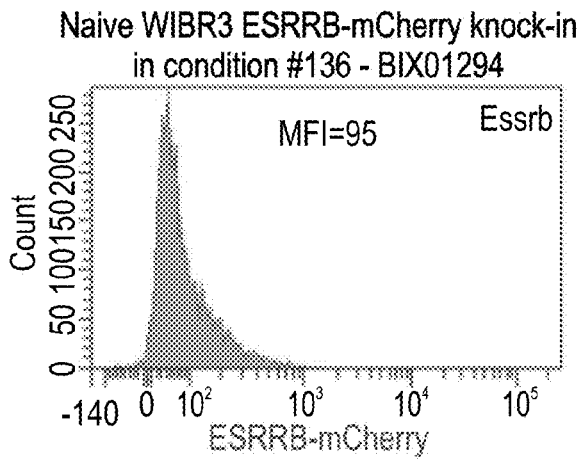

FIGS. 26A-C depict the targeting human ESRRB (a gene/transcription factor) locus with knockin mCherry fluorescent reporter. FIG. 26A—Targeting scheme is illustrated. Scissors indicate CRISPR—sgRNA cut site. In order to create mCherry reporter co-expressed with endogenous human ESRRB locus, the present inventors have chosen to knock in p2a-mCherry coding sequence in frame with the last exon of the human ESRRB gene. The present inventors have inserted oligos specific for the stop codon region of ESRRB gene into px335 plasmid which encodes CAS9 nickase and sgRNA. The donor construct was made as indicated in FIG. 26A. The present inventors have targeted WIBR3 human ESC OCT4 GFP knockin cell line. The efficiency of the targeting was about 30% (15 out of 48 clones) as verified by external PCR. Correct targeting was also verified by Southern Blot (SB) with external and anti-mCherry probes (FIG. 26B). After Neo cassette excision with Flippase, the whole targeted locus from one of the clones was amplified and sequenced. Clones 2-6 were correctly targeted (FIG. 26C).

Figure 26F:
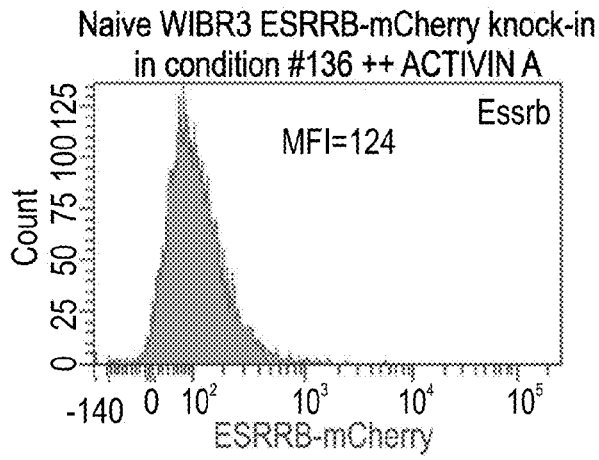

FIGS. 26D-H are FACS analyses depicting expression of ESRRB-mCherry reporter in PSCs. WIBR3 hESCs, with (FIGS. 26E, 26F, and 26H) or without (FIGS. 26D and 26G) ESRRB mCherry knock-in reporter, expanded in the indicated conditions were dissociated to a single-cell suspension using 0.05% trypsin-EDTA, and resuspended in ice-cold FACS buffer (2% (vol/vol) Fetal Bovine Serum (FBS) in PBS (phosphate buffered saline). Then cells were simultaneously analyzed using the flow cytometer FACSAria II with FACSDiva software version 6.1.3 (BD Biosciences) for the ESRRB-mCherry expression. MFI=Mean fluorescence intensity. The results indicate how Naïve conditions 136 specifically induce ESRRB mCherry expression (compare FIG. 26E to 26D) and that this effect is lost when BIX01294 is removed from the culture medium (FIG. 26H as compared to FIG. 26E), or when Activin A is added (FIG. 26F). These results show that some of the naïve compositions described herein specifically induce the naïve pluripotent transcription factor ESRRB.

DESCRIPTION OF SPECIFIC EMBODIMENTS OF THE INVENTION

The present invention, in some embodiments thereof, relates to novel culture media which can be used to generate and expand pluripotent stem cells in general and more particularly naive pluripotent stem cells.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have uncovered novel conditions, which are required for isolating and generating a primate (e.g., human) naive pluripotent stem cell, and maintaining same in the naive state.

Thus, as shown in Example 5 of the Examples section which follows, and in FIGS. 7-16, the present inventors have uncovered that the novel conditions including a culture medium capable of maintaining naive PSCs in the "naive state" as explained herein under, and as was evidenced by the expression of OCT4-GFP+ (positive) cells. Such a culture medium comprises a STAT3 activator, MEK/ERK1/2 inhibitor (e.g., PD0325901), and an Axin stabilizer.

As used herein the phrase "naive state" refers to being in an undifferentiated state wherein both alleles of the promoter of the X-inactive specific transcript (XIST) gene of the female cell are unmethylated, or wherein the promoter of the XIST allele of the male cell is unmethylated.

According to an aspect of some embodiments of the present invention there is provided a culture medium comprising a STAT3 activator, an ERK1/2 inhibitor and an Axin stabilizer.

As used herein the phrase "culture medium" refers to a solid or a liquid substance used to support the growth of stem cells and maintain them in an undifferentiated state. Preferably, the phrase "culture medium" as used herein refers to a liquid substance capable of maintaining the stem cells in an undifferentiated state.

The culture medium used by the present invention can be a water-based medium which includes a combination of substances such as salts, nutrients, minerals, vitamins, amino acids, nucleic acids, proteins such as cytokines, growth factors and hormones, all of which are needed for cell proliferation and are capable of maintaining the stem cells in an undifferentiated state. For example, a culture medium can be a synthetic tissue culture medium such as Ko-DMEM (Gibco-Invitrogen Corporation products, Grand Island, NY, USA), DMEM/F12 (Gibco-Invitrogen Corporation products, Grand Island, NY, USA), Neurobasal medium (Invitrogen Corporation products, Grand Island, NY, USA 21103-049) or DMEM/F12 (without HEPES; Biological Industries, Beit Haemek, Israel), supplemented with the necessary additives as is further described herein under.

According to a particular embodiment, the medium is a 1:1 mix of Neurobasal medium and DMEM F/12.

According to still another embodiment, the medium is MTESR1 (Stem Cell Technologies). In some instances, this medium already comprises TGF beta and FGF2 and accordingly is only appropriate for preparation of those media which comprise these growth factors. In other instances, the medium is made without FGF and TGF (see for example Ludwing and Thomson: Curr. Protoc. Stem Cell Biol. 2:1C.2.1-1C.2.16).

Preferably, all ingredients included in the culture medium of the present invention are substantially pure, with a tissue culture grade.

According to some embodiments of the invention, the culture medium is devoid of serum, e.g., devoid of any animal serum.

According to some embodiments of the invention, the culture medium is devoid of any animal contaminants, i.e., animal cells, fluid or pathogens (e.g., viruses infecting animal cells), e.g., being xeno-free.

According to some embodiments of the invention, the culture medium is devoid of human derived serum.

According to some embodiments of the invention, the culture medium further comprises a serum replacement (i.e., a substitute of serum) such as KNOCKOUT™ Serum Replacement (Gibco-Invitrogen Corporation, Grand Island, NY USA), ALBUMAX®II (Gibco®; Life Technologies—Invitrogen, Catalogue No. 11021-029; Lipid-rich bovine serum albumin for cell culture) or a chemically defined lipid concentrate (Gibco®; Invitrogen, Life Technologies—Invitrogen, Catalogue No. 11905-031).

According to some embodiments of the invention, the culture medium further comprises N2 supplement (Gibco®; Life Technologies—Invitrogen, Catalogue No. 17502-048) a chemically defined, serum-free supplement. For a 500 ml of culture medium 5 ml of the N2 mix (Invitrogen) can be added.

Alternatively, the following materials (substitute the N2 supplement) can be added to a 500 ml culture medium: Recombinant Insulin (Sigma I-1882) at a 12.5 microg/ml (µg/ml) final concentration; Apo-Transferrin (Sigma T-1147) at a 500 µg/ml final concentration; Progesterone (Sigma-P8783) at a 0.02 µg/ml final concentration; Putrescine (Sigma-P5780) at a 16 µg/ml final concentration; and 5 microL (µl) of 3 mM stock of Sodium Selenite (Sigma—S5261) are added per 500 ml culture medium [i.e., at a final concentration of 3 nM (e.g., the WIS-NHSM)].

According to some embodiments of the invention, the KNOCKOUT™ Serum Replacement is provided at a concentration of at least 0.5%, e.g., in the range of about 0.5%-25%, e.g., about 5%, about 10%, about 15%, about 20% or about 25%.

According to some embodiments of the invention, the ALBUMAX™ is provided at a concentration of at least 0.01%, e.g., in the range of about 0.01%-10%, e.g., about 0.1%, about 0.2%, about 0.3%, about 0.4%, about 0.5%, about 0.6%, about 0.7%, about 0.8%, about 0.9%, about 1%, about 2%, about 3%, about 4%, about 5%, about 6%, about 7%, about 8%, about 9% or about 10%, e.g., 1%.

According to some embodiments of the invention, the defined lipid concentrate is provided at a concentration of at least about 0.1%, e.g., in the range of 0.1-5%, e.g., about 0.2%, about 0.3%, about 0.4%, about 0.5%, about 0.6%, about 0.7%, about 0.8%, about 0.9%, about 1%, about 2%, about 3%, about 4%, about 5%, e.g., 1%.

According to some embodiments of the invention, the culture medium comprises the N2 supplement (e.g., 5 ml N2 per 500 ml of culture medium) and the defined lipid concentrate (5 ml defined lipid concentrate per 500 ml medium).

According to some embodiments of the invention, the culture medium comprises the N2 supplement (e.g., 5 ml N2 per 500 ml of culture medium) and ALBUMAX®II (e.g., 1% Albumax®II; Gibco®; Life Technologies—Invitrogen).

According to some embodiments of the invention, the culture medium can further include antibiotics (e.g., PEN-STREP), L-glutamine, NEAA (non-essential amino acids).

As used herein the term "STAT3" refers to the signal transducer and activator of transcription 3 gene product (acute-phase response factor) (Gene ID 6774). In response to cytokines and growth factors, STAT family members are phosphorylated by the receptor associated kinases, and then form homo- or heterodimers that translocate to the cell nucleus where they act as transcription activators. Known STAT3 activators include, but are not limited to, interferon (IFN), epidermal growth factor (EGF), interleukin 5 (IL5), interleukin 6 (IL6), hepatocyte growth factor (HGF), leukemia inhibitory factor (LIF) and bone morphogenetic protein 2 (BMP2).

According to some embodiments of the invention, the STAT3 activator, which is used in the medium of some embodiments of the invention, is selected from the group consisting of LIF, IL6 and EGF.

According to some embodiments of the invention, the STAT3 activator, which is used in the medium of some embodiments of the invention, is selected from the group consisting of LIF and IL6.

According to some embodiments of the invention, the STAT3 activator, which is used in the medium of some embodiments of the invention is LIF.

As used herein the term "leukemia inhibitor factor (LIF)" refers to a polypeptide which comprises the amino acid sequence as set forth by GenBank Accession No. NP_001244064.1 (SEQ ID NO:119), encoded by the nucleotide sequence set forth in GenBank Accession No. NM_001257135 (SEQ ID NO:30). Preferably, the LIF used by the method according to some embodiments of the invention is capable of supporting, along with other factors which are described herein, the undifferentiated growth of naive primate (e.g., human) PSCs, while maintaining their pluripotent capacity. LIF can be obtained from various manufacturers such as Millipore, Peprotech, and R&D systems.

According to some embodiments of the invention, LIF is provided at a concentration range from about 0.5 nanogram per milliliter (ng/ml) to about 1000 ng/ml, e.g., about 1-1000 ng/ml, e.g., about 1-900 ng/ml, e.g., about 1-800 ng/ml, e.g., about 1-700 ng/ml, e.g., about 1-600 ng/ml, e.g., about 1-500 ng/ml, e.g., about 1-400 ng/ml, e.g., about 1-300 ng/ml, e.g., about 1-200 ng/ml, e.g., about 1-100 ng/ml, e.g., about 1-50 ng/ml, e.g., about 2-50 ng/ml, e.g., about 4-50 ng/ml, e.g., about 5-50 ng/ml, e.g., about 10-50 ng/ml, e.g., about 10-40 ng/ml, e.g., about 10-30 ng/ml, e.g., about 20 ng/ml.

As used herein the term "interleukin 6 (IL6)" refers to a polypeptide which comprises the amino acid sequence set forth by GenBank Accession No. NP_000591.1 (SEQ ID NO: 120), which is encoded by the nucleic acid set forth by GenBank Accession No. NM_000600.3 (SEQ ID NO: 111). Preferably, the IL6 used by the method according to some embodiments of the invention is capable of supporting, along with other factors which are described herein, the undifferentiated growth of naive primate (e.g., human) PSCs, while maintaining their pluripotent capacity. IL6 can be obtained from various manufacturers such as Speed BioSystems, Millipore, Peprotech, and R&D systems.

According to some embodiments of the invention, IL6 is provided at a concentration range from about 0.1 ng/ml to about 100 ng/ml, e.g., about 0.1-90 ng/ml, e.g., about 0.1-80 ng/ml, e.g., about 0.1-70 ng/ml, e.g., about 0.1-50 ng/ml, e.g., about 0.1-40 ng/ml, e.g., about 0.1-30 ng/ml, e.g., about 0.1-20 ng/ml, e.g., about 0.1-10 ng/ml, e.g., about 0.1-8 ng/ml, e.g., about 0.1-7 ng/ml, e.g., about 0.1-6 ng/ml, e.g., about 0.1-5 ng/ml, e.g., about 0.1-4 ng/ml, e.g., about 0.1-3 ng/ml, e.g., about 0.1-4 ng/ml, e.g., about 0.5-4 ng/ml, e.g., about 0.5-4 ng/ml, e.g., about 3 ng/ml.

As used herein the term "EGF" refers to the epidermal growth factor gene product. The encoded protein (EGF) is synthesized as a large precursor molecule that is proteolytically cleaved to generate the 53-amino acid epidermal growth factor peptide. The EGF protein acts a potent mitogenic factor that plays an important role in the growth, proliferation and differentiation of numerous cell types; it acts by binding the high affinity cell surface receptor, epidermal growth factor receptor. The EGF protein, which can be used according to some embodiments of the invention comprises any of the EGF isoforms 1-3, which result from alternate splicing. Thus, transcript variant 1 [GenBank Accession No. NM_001963.4 (SEQ ID NO: 179)], represents the longest transcript and encodes the longest isoform, i.e., isoform 1 [GenBank Accession No. NP_001954.2 (SEQ ID NO:178)]. Transcript variant 2 [GenBank Accession No. NM_001178130.1 (SEQ ID NO: 181)], which lacks an in-frame exon in the coding region compared to variant 1, encodes isoform 2 [GenBank Accession No. NP_001171601.1 (SEQ ID NO:180)]. Transcript variant 3 [GenBank Accession No. NM_001178131.1 (SEQ ID NO: 183)], which lacks an in-frame exon in the coding region, compared to variant 1, encodes isoform 3 [GenBank Accession No. NP_001171602.1 (SEQ ID NO: 182)].

According to some embodiments of the invention, EGF is provided at a concentration range from about 1 ng/ml to about 20 ng/ml, e.g., between about 2-20 ng/ml, e.g., between about 3-19 ng/ml, e.g., between about 4-18 ng/ml, e.g., between about 5-15 ng/ml, e.g., about 1 ng/ml, e.g., about 2 ng/ml, e.g., about 3 ng/ml, e.g., about 4 ng/ml, e.g., about 5 ng/ml, e.g., about 6 ng/ml, e.g., about 7 ng/ml, e.g., about 8 ng/ml, e.g., about 9 ng/ml, e.g., about 10 ng/ml, e.g., about 11 ng/ml, e.g., about 12 ng/ml, e.g., about 13 ng/ml, e.g., about 14 ng/ml, e.g., about 15 ng/ml, e.g., about 16 ng/ml, e.g., about 17 ng/ml, e.g., about 18 ng/ml, e.g., about 19 ng/ml, e.g., about 20 ng/ml.

As used herein the term "ERK1" refers to the mitogen-activated protein kinase 3 (MAPK3) isoform 1 set forth by GenBank Accession No. NP_002737.2 (SEQ ID NO:33), the MAPK3 isoform 2 set forth by GenBank Accession No. NP_001035145.1 (SEQ ID NO:34), the MAPK3 isoform 3 set forth by GenBank Accession No. NP_001103361.1 (SEQ ID NO:35) and/or ERK1 set forth in GenBank Accession No. M84490 (SEQ ID NO:36) having the MAPK signaling activity.

As used herein the term "ERK2" refers to the mitogen-activated protein kinase 1 (MAPK1) set forth by GenBank Accession No. NP_002736.3 (SEQ ID NO:37) and/or GenBank Accession No. NP_620407.1 (SEQ ID NO:38) having the MAPK signaling activity.

As used herein the term "ERK1/2 inhibitor" refers to any molecule capable of inhibiting the activity of ERK1/2 as determined by Western blot protein detection of phosphorylated ERK1/2 proteins.

Non-limiting examples of ERK1/2 inhibitors (also known as MEK1/2 inhibitors) include PD0325901 (AXONMED-CHEM—AXON 1408), PD98059 (AXONMEDCHEM—Axon 1223), and PD184352 (AXONMEDCHEM—AXON 1368).

It will be appreciated that inhibition of ERK1/2 activity can be also achieved by inhibition of a protein(s) which activity thereof directly affects the activity of ERK1/2. Such a protein(s) is considered to be "upstream" of the MEK/ERK pathway, i.e., a protein (e.g., A-RAF, B-RAF and C-RAF), which inhibition thereof results in a subsequent inhibition of the ERK1/2 protein activity. Non-limiting examples of inhibitors of the BRAF and CRAF proteins which also result in inhibition of ERK1/2 activity include Sorafenib tosylate (also known as BAY 43-9006 AXONMEDCHEM—AXON 1397) or SB 590885 (TOCRIS #2650) as is further described hereinbelow.

According to some embodiments of the invention, PD0325901 is provided at a concentration range from about 0.01 microM (µM) to about 50 µM, e.g., between about 0.05-45 µM, e.g., between about 0.1-50 µM, e.g., between about 0.1-45 µM, e.g., between about 0.1-40 µM, e.g., between about 0.1-35 µM, e.g., between about 0.1-30 µM, e.g., between about 0.1-25 µM, e.g., between about 0.1-20 µM, e.g., between about 0.1-15 µM, e.g., between about 0.1-10 µM, e.g., between about 0.2-10 µM, e.g., between about 0.3-10 µM, e.g., between about 0.4-10 µM, e.g., between about 0.5-10 µM, e.g., between about 0.6-10 µM, e.g., between about 0.7-10 µM, e.g., between 0.8-10 µM, e.g., between 0.9-10 µM, e.g., between 0.9-9 µM, e.g., between 0.9-8 µM, e.g., between 0.9-7 µM, e.g., between 0.9-6 µM, e.g., between 0.8-5 µM, e.g., between 0.8-4 µM, e.g., between 0.8-3 µM, e.g., between 0.8-2 µM, e.g., between 0.8-1.5 µM, e.g., between 0.9-1.2 µM, e.g., about 1 µM.

According to some embodiments of the invention, PD98059 is provided at a concentration range from about 0.1 microM (µM) to about 70 µM, e.g., between about 0.1-65 µM, e.g., between about 0.1-55 µM, e.g., between about 0.1-50 µM, e.g., between about 0.1-45 µM, e.g., between about 0.1-40 µM, e.g., between about 0.1-35 µM, e.g., between about 0.1-30 µM, e.g., between about 0.1-25 µM, e.g., between about 0.1-20 µM, e.g., between about 0.1-15 µM, e.g., between about 2-20 µM, e.g., between about 5-15 µM, e.g., about 10 µM, e.g., between about 0.1-10 µM, e.g., between about 0.2-10 µM, e.g., between about 0.3-10 µM, e.g., between about 0.4-10 µM, e.g., between about 0.5-10 µM, e.g., between about 0.6-10 µM, e.g., between about 0.7-10 µM, e.g., between 0.8-10 µM, e.g., between 0.9-10 µM, e.g., between 0.9-9 µM, e.g., between 0.9-8 µM, e.g., between 0.9-7 µM, e.g., between 0.9-6 µM, e.g., between 0.8-5 µM, e.g., between 0.8-4 µM, e.g., between 0.8-3 µM, e.g., between 0.8-2 µM, e.g., between 0.8-1.5 µM, e.g., between 0.9-1.2 µM.

According to some embodiments of the invention, PD184352 is provided at a concentration range from about 0.1 microM (µM) to about 70 µM, e.g., between about 0.1-60 µM, e.g., between about 0.1-50 µM, e.g., between about 0.5-50 µM, e.g., between about 0.5-45 µM, e.g., between about 0.5-40 µM, e.g., between about 0.1-35 µM, e.g., between about 0.5-30 µM, e.g., between about 0.5-25 µM, e.g., between about 0.5-20 µM, e.g., between about 0.5-15 µM, e.g., between about 0.5-10 µM, e.g., between 0.5-9 µM, e.g., between 0.5-8 µM, e.g., between 0.5-7 µM, e.g., between 0.9-6 µM, e.g., between 0.8-5 µM, e.g., between 0.8-4 µM, e.g., between 0.8-3 µM, e.g., about 3 µM. e.g., between 0.8-2 µM, e.g., between 0.8-1.5 µM, e.g., between 0.9-1.2 µM.

The AXIN destruction complex is a multiprotein "destruction complex" that includes the tumor suppressors Axin and adenomatous polyposis coli (APC), the Ser/Thr kinases GSK-3 and CK1.

The use of GSK3b inhibitors allows stabilization of beta-catenin effector that has cytoplasmic and nuclear downstream functions. The use of small molecules that stabilize AXIN destruction complex together with GSK3b inhibitors allow increasing the stabilized beta-catenin function in the cytoplasm at the expense of that found in the nucleus. Such an approach has been used to reduce dependence on FGF2 signaling in mouse and human primed cells (Kim, H., et al., 2013. Modulation of b-catenin function maintains mouse epiblast stem cell and human embryonic stem cell self-renewal. Nature Communications 4, 1-11).

Recently, two groups of chemical substances (IWR-1—Sigma Aldrich 10161; and XAV939—TOCRIS cat. No. 3748, or Sigma cat. No. X3004) have been identified which stabilize the destruction complex structure and/or activity (Chen et al., Nat. Chem. Biol. 5: 100-107, 2009; and Huang et al., Nature: 461: 614-620, 2009). By blocking the PARP domain of Tankyrase, XAV939 and IWR-1 are thought to alter the PARsylation and ubiquitination of AXIN2 that results in its increased stability and in inhibition of canonical Wnt signaling. IWR compounds induce stabilization of Axin proteins via a direct interaction, which is a part of the beta-catenin destruction complex (consists of Apc, Axin1/2, Ck1 and Gsk3b).

Additional AXIN stabilizers which can be used according to some embodiments of the invention include, but are not limited to, IWP2 (available from TOCRIS Cat. No. 3533, e.g., at a concentration of about 2 microM); Lysophosphatidilic acid (LPA; available from Santa Cruz, Cat. No. sc201053, e.g., at a concentration of about 1-10 microM); WNT5a (available from RnD system, Cat. No. 645-WN-010, e.g., at a concentration of about 1-20 ng/ml).

According to a particular embodiment, the AXIN complex stabilizer is a small molecule compound.

According to another embodiment, the AXIN complex stabilizer is IWR-1.

According to some embodiments of the invention, the AXIN stabilizer (e.g. IWR-1) is provided at a concentration range of between about 0.1-70 µM, e.g., from about 0.2 µM to about 70 µM, e.g., between about 0.2-60 µM, e.g., between about 0.2-55 µM, e.g., between about 0.2-50 µM, e.g., between about 0.2-45 µM, e.g., between about 0.2-40 µM, e.g., between about 0.2-35 µM, e.g., between about 0.2-30 µM, e.g., between about 0.2-25 µM, e.g., between about 0.2-20 µM, e.g., between about 0.2-15 µM, e.g., between about 0.2-10 µM, e.g., between about 0.3-10 µM, e.g., between about 0.4-10 µM, e.g., between about 0.5-10 µM, e.g., between about 0.6-10 µM, e.g., between about 0.7-10 µM, e.g., between 0.8-10 µM, e.g., between 0.9-10 µM, e.g., between 0.9-9 µM, e.g., between 1-8 µM, e.g., between 1-7 µM, e.g., between 1-6 µM, e.g., between 1-5 µM, e.g., about 1-3 µM, e.g., about 2 µM, e.g., about 5 µM.

According to another embodiment, the AXIN complex stabilizer is XAV939.

According to some embodiments of the invention, the AXIN stabilizer (e.g. XAV939, IWP2 and/or LPA) is provided at a concentration range of between about 0.1-70 µM, e.g., about 0.1-20 µM, e.g., from about 0.2 µM to about 70 µM, e.g., between about 0.2-60 µM, e.g., between about 0.2-55 µM, e.g., between about 0.2-50 µM, e.g., between about 0.2-45 µM, e.g., between about 0.2-40 µM, e.g., between about 0.2-35 µM, e.g., between about 0.2-30 µM, e.g., between about 0.2-25 µM, e.g., between about 0.2-20 µM, e.g., between about 0.2-15 µM, e.g., between about 0.2-10 µM, e.g., between about 0.3-10 µM, e.g., between about 0.4-10 µM, e.g., between about 0.5-10 µM, e.g., between about 0.6-10 µM, e.g., between about 0.7-10 µM, e.g., between 0.8-10 µM, e.g., between 0.9-10 µM, e.g., between 1-10 µM, e.g., between 0.9-9 µM, e.g., between 1-8 µM, e.g., between 1-7 µM, e.g., between 1-6 µM, e.g., between 1-5 µM, e.g., about 1-3 µM, e.g., about 2 µM.

According to some embodiments of the invention, the AXIN stabilizer WNT5a is provided at a concentration range of between about 1 ng/ml and about 20 ng/ml, e.g., about 2-20 ng/ml, e.g., about 3-20 ng/ml, e.g., about 4-20 ng/ml, e.g., about 5-20 ng/ml, e.g., about 6-20 ng/ml, e.g., about 7-20 ng/ml, e.g., about 8-20 ng/ml, e.g., about 9-20 ng/ml, e.g., about 10-20 ng/ml, e.g., about 10-19 ng/ml, e.g., about 10-18 ng/ml, e.g., about 10-15 ng/ml, e.g., about 20 ng/ml.

According to some embodiments of the invention, the culture medium further comprises a PKC inhibitor.

According to an aspect of some embodiments of the present invention there is provided a culture medium comprising a STAT3 activator, an ERK1/2 inhibitor, an Axin stabilizer and a PKC inhibitor.

As used herein the term "protein kinase C (PKC)" refers to PKCα (alpha), PKCβ (beta), PKCγ (gamma), PKCδ (delta), PKCζ (zeta) and PKCμ (mu) protein isoforms.

As used herein the term "protein kinase C inhibitor" refers to any molecule capable of inhibiting the activity of protein kinase C as determined by reducing the levels of phosphorylated versus non phosphorylated PKC isoforms.

A non-limiting example of a protein kinase C inhibitor is Go6983 (CAS 133053-19-7), a potent, cell-permeable, reversible, and ATP-competitive inhibitor of protein kinase C (PKC) with a broad spectrum protein kinase C (PKC) inhibitor (IC50 values are 7, 7, 6, 10, 60 and 20000 nM for PKCα, PKCβ, PKCγ, PKCδ, PKCζ and PKCμ respectively). Go6983 is available from various suppliers such as Calbiochem (Catalogue number 365251-500UG), and TOCRIS (Catalogue number 2285).

According to some embodiments of the invention, Go6983 is provided at a concentration range of between about 0.5-100 μM, e.g., from about 1 μM to about 100 μM, e.g., between about 1-90 μM, e.g., between about 1-80 μM, e.g., between about 1-70 μM, e.g., between about 1-60 μM, e.g., between about 1-55 μM, e.g., between about 1-50 μM, e.g., between about 1-45 μM, e.g., between about 1-40 μM, e.g., between about 1-35 μM, e.g., between about 1-30 μM, e.g., between about 1-25 μM, e.g., between about 1-20 μM, e.g., between about 1-15 μM, e.g., between about 1-10 μM, e.g., between about 2-10 μM, e.g., between about 3-10 μM, e.g., between about 4-10 μM, e.g., between about 4-6 μM, e.g., about 5 μM.

According to some embodiments of the invention, the medium further comprises a GSK3b inhibitor.

Thus, according to an aspect of some embodiments of the present invention there is provided a culture medium comprising a STAT3 activator, an ERK1/2 inhibitor, an Axin stabilizer, a PKC inhibitor and a GSK3b inhibitor.

As used herein the term "GSK3b" refers to the glycogen synthase kinase 3 beta protein set forth by GenBank Accession Nos. NP_002084.2 (SEQ ID NO: 121) and/or NP_001139628.1 (SEQ ID NO: 122) having the WNT signaling regulatory activity via its kinase activity.

As used herein the term "GSK3b inhibitor" refers to any molecule capable of inhibiting the activity of GSK3b as determined by specifically inhibiting levels of phosphorylated GSK3b (out of total GSK3b present in a cell).

Non-limiting examples of GSK3b inhibitors include CHIR99021 (AXONMEDCHEM—AXON 1386), BIO (AXONMEDCHEM—Axon 1693), and Kenpaullone (TOCRIS—cat no. 1398).

According to some embodiments of the invention, CHIR99021 is provided at a concentration range of between about 0.1-50 μM, e.g., from about 0.2 μM to about 50 μM, e.g., between about 0.2-45 μM, e.g., between about 0.2-50 μM, e.g., between about 0.2-45 μM, e.g., between about 0.2-40 μM, e.g., between about 0.2-35 μM, e.g., between about 0.2-30 μM, e.g., between about 0.2-25 μM, e.g., between about 0.2-20 μM, e.g., between about 0.2-15 μM, e.g., between about 0.2-10 μM, e.g., between about 0.2-10 μM, e.g., between about 0.3-10 μM, e.g., between about 0.4-10 μM, e.g., between about 0.5-10 μM, e.g., between about 0.6-10 μM, e.g., between about 0.7-10 μM, e.g., between 0.8-10 μM, e.g., between about 0.9-10 μM, e.g., between 0.9-9 μM, e.g., between 1-8 μM, e.g., between 1-7 μM, e.g., between 1-6 μM, e.g., between 1-5 μM, e.g., between 2-4 μM, e.g., about 3 μM.

According to some embodiments of the invention, BIO is provided at a concentration range of between about 0.1-70 μM, e.g., from about 0.2 μM to about 70 μM, e.g., between about 0.2-60 μM, e.g., between about 0.2-55 μM, e.g., between about 0.2-50 μM, e.g., between about 0.2-45 μM, e.g., between about 0.2-40 μM, e.g., between about 0.2-35 μM, e.g., between about 0.2-30 μM, e.g., between about 0.2-25 μM, e.g., between about 0.2-20 μM, e.g., between about 0.2-15 μM, e.g., between about 0.2-10 μM, e.g., between about 0.3-10 μM, e.g., between about 0.4-10 μM, e.g., between about 0.5-10 μM, e.g., between about 0.6-10 μM, e.g., between about 0.7-10 μM, e.g., between 0.8-10 μM, e.g., between 0.9-10 μM, e.g., between 0.9-9 μM, e.g., between 1-8 μM, e.g., between 1-7 μM, e.g., between 1-6 μM, e.g., between 1-5 μM, e.g., about 5 μM, e.g., between 2-4 μM.

According to some embodiments of the invention, Kenpaullone is provided at a concentration range of between about 0.1-70 μM, e.g., from about 0.2 μM to about 70 μM, e.g., between about 0.2-60 μM, e.g., between about 0.2-55 μM, e.g., between about 0.2-50 μM, e.g., between about 0.2-45 μM, e.g., between about 0.2-40 μM, e.g., between about 0.2-35 μM, e.g., between about 0.2-30 μM, e.g., between about 0.2-25 μM, e.g., between about 0.2-20 μM, e.g., between about 0.2-15 μM, e.g., between about 0.2-10 μM, e.g., between about 0.3-10 μM, e.g., between about 0.4-10 μM, e.g., between about 0.5-10 μM, e.g., between about 0.6-10 μM, e.g., between about 0.7-10 μM, e.g., between 0.8-10 μM, e.g., between 0.9-10 μM, e.g., between 0.9-9 μM, e.g., between 1-8 μM, e.g., between 1-7 μM, e.g., between 1-6 μM, e.g., between 1-5 μM, e.g., between 2-4 μM, e.g., about 5 μM.

According to some embodiments of the invention, the medium further comprises at least one agent selected from the group consisting of: a ROCK inhibitor, an SRC inhibitor, ascorbic acid, a PKA agonist, a YAP/TAZ inhibitor, a NOTCH inhibitor, an SHH inhibitor, a TGFβR inhibitor, a BMP inhibitor, an FGFR inhibitor, a JNK inhibitor, an ERK5 inhibitor, a BRAF inhibitor, a CRAF inhibitor, an ARAF inhibitor, a p38 inhibitor, a GSK3b inhibitor, an LSD1 inhibitor, a PI3K activator (or booster), a SMAD activator and a DOT1L inhibitor.

As used herein the term "ROCK" refers to the protein set forth by GenBank Accession No. NP_005397.1 (P160ROCK; SEQ ID NO: 50); and NP_004841.2 (ROCK2; SEQ ID NO:51) having the serine/threonine kinase activity, and regulates cytokinesis, smooth muscle contraction, the formation of actin stress fibers and focal adhesions, and the activation of the c-fos serum response element.

As used herein the term "ROCK inhibitor" refers to any molecule capable of inhibiting the activity of ROCK as determined by inhibition of ROCK phosphorylation levels (detected by western blot analysis).

Non-limiting examples of ROCK inhibitors include Y27632 (TOCRIS, Catalogue number 1254), Blebbistatin (TOCRIS Catalogue number 1760) and Thiazovivin (Axon Medchem—Axon 1535). Blebbistatin is a selective inhibitor of myosin II ATpase, a downstream effector of ROCK pathway, and thus effectively leads to ROCK pathway inhibition (Chen G1, Hou Z et al. Actin-myosin contractility is responsible for the reduced viability of dissociated human embryonic stem cells. Cell Stem Cell. 2010; 7(2):240-8, which is fully incorporated herein by reference in its entirety).

According to some embodiments of the invention, Y27632 is provided at a concentration range of between about 0.1-100 μM, e.g., from about 0.1 μM to about 90 μM, e.g., between about 0.1-85 μM, e.g., between about 0.1-80 μM, e.g., between about 0.1-70 μM, e.g., between about 0.1-60 μM, e.g., between about 0.1-55 μM, e.g., between about 0.1-50 µM, e.g., between about 0.1-45 µM, e.g., between about 0.1-40 µM, e.g., between about 0.1-35 µM, e.g., between about 0.1-30 µM, e.g., between about 0.1-25 µM, e.g., between about 1-20 µM, e.g., between about 1-15 µM, e.g., between about 1-10 µM, e.g., between about 2-10 µM, e.g., between about 3-10 µM, e.g., between about 4-10 µM, e.g., between about 4-6 µM, e.g., about 5 µM.

According to some embodiments of the invention, Blebbistatin is provided at a concentration range of between about 0.5 µM to about 10 µM, e.g., from about 0.5 µM to about 9 µM, e.g., between about 0.5-8.5 µM, e.g., between about 0.5-8 µM, e.g., between about 0.5-7 µM, e.g., between about 0.5-6 µM, e.g., between about 0.5-5.5 µM, e.g., between about 0.5-5 µM, e.g., between about 0.5-4.5 µM, e.g., between about 0.5-4 µM, e.g., between about 0.5-3.5 µM, e.g., between about 0.5-3 µM, e.g., between about 0.5-2.5 µM, e.g., between about 1-2 µM, e.g., e.g., about 5 µM.

According to some embodiments of the invention, Thiazovivin is provided at a concentration range of between about 0.1 µM to about 5 µM, e.g., from about 0.1 µM to about 4 µM, e.g., from about 0.1 to about 3 µM, e.g., from about 0.2 µM to about 2.5 µM, e.g., from about 0.3 µM to about 2 µM, e.g., from about 0.3 µM to about 1 µM, e.g., from about 0.3 to about 0.8 µM, e.g., between 0.4-0.6 µM, e.g., about 0.4 µM, e.g., about 0.5 µM As used herein the term "SRC" refers to the SRC proto-oncogene, non-receptor tyrosine kinase, which may play a role in the regulation of embryonic development and cell growth. The protein encoded by this gene is a tyrosine-protein kinase whose activity can be inhibited by phosphorylation by c-SRC kinase. Two transcript variants encoding the same protein (GenBank Accession NO. NP_005408.1 (SEQ ID NO:134) have been found for this gene [GenBank Accession Nos. NM_005417.4 (SEQ ID NO:135) and NM_198291.2 (SEQ ID NO:136)].

Src signaling promotes epithelial to mesenchymal transition and is an upstream stimulator of JNK pathway. Small molecule inhibitions of SRC pathways has been shown to support expansion of mouse pluripotent cells (Li, X., et al., 2011. Calcineurin-NFAT Signaling Critically Regulates Early Lineage Specification in Mouse Embryonic Stem Cells and Embryos. Stem Cell 8, 46-58; and Shimizu, T., et al., 2012. Dual Inhibition of Src and GSK3 Maintains Mouse Embryonic Stem Cells, Whose Differentiation Is Mechanically Regulated by Src Signaling. Stem Cells 30, 1394-1404). The phrase "src family kinase inhibitor" refers to any agent which is effect to impede or inhibit the function of the src kinase family. Such agents include, without limitation, small molecules, chemical compounds and nucleic acid molecules which function to down regulate expression of target genes and inhibit the function of direct and indirect c-Src substrates, such as the focal adhesion kinase, signal transducer and activator of transcription 3 (STAT3), vascular endothelial growth factor (VEGF), paxillin, Cas, p190RhoGAP, Ras, E-cadherin, c-Jun amino-terminal kinase, NEDD9, and others. Exemplary agents include dasatinib, SU6656, and AZD05530. Src inhibitors are also available from Wyeth and include for example, 4-[(2,4-Dichloro-5-methoxyphenyl)amino]-7-[3-(4-ethyl-1-piperazinyl)propoxy]-6-methoxy-3-quinolinecarbonitrile; 4-[(2,4-Dichloro-5-methoxyphenyl)amino]-6-methoxy-7-[2-(4-methyl-1-piperazinyl)ethoxy]-3-quinolinecarbonitrile; 4-[(2,4-Dichloro-5-methoxyphenyl)amino]-7-[2-(4-ethyl-1-piperazinyl)ethoxy]-6-methoxy-3-quinolinecarbonitrile; 4-[(2,4-Dichloro-5-methoxyphenyl)amino]-6-methoxy-7-[(1-methylpiperidin-4-yl)methoxy]-3-quinolinecarbonitrile; 4-[(2,4-Dichloro-5-methoxyphenyl)amino]-6-methoxy-7-[2-(1-methylpiperidin-4-yl)ethoxy]-3-quinolinecarbonitrile; 4-[(2,4-Dichloro-5-methoxyphenyl)amino]-6-methoxy-7-[3-(1-methylpiperidin-4-yl)propoxy]quinoline-3-carbonitrile; 4-[(2,4-Dichloro-5-methoxyphenyl)amino]-7-[(1-ethylpiperidin-4-yl)methoxy-]-6-methoxyquinoline-3-carbonitrile; 4-[(2,4-Dichloro-5-methoxyphenyl)amino]-6-ethoxy-7-[3-(4-methylpiperazin-1-yl)propoxy]quinoline-3-carbonitrile; 4-[(2,4-Dichloro-5-methoxyphenyl)amino]-6-ethoxy-7-[(1-methylpiperidin-4-yl)methoxy]quinoline-3-carbonitrile; 4-[(2,4-Dichloro-5-methoxyphenyl)amino]-6-ethoxy-7-[3-(4-ethylpiperazin-1-yl)propoxy]quinoline-3-carbonitrile; 4-[(2,4-Dichloro-5-methoxyphenyl)amino]-6-ethoxy-7-[3-(1-methylpiperidin-4-yl)propoxy]quinoline-3-carbonitrile; 4-[(2,4-Dichloro-5-methoxyphenyl)amino]-6-ethoxy-7-[2-(4-methyl-1-piperazinyl)ethoxy]quinoline-3-carbonitrile; 4-[(2,4-Dichloro-5-methoxyphenyl)amino]-6-ethoxy-7-[2-(1-methylpiperidin-4-yl)ethoxy]quinoline-3-carbonitrile; or 4-[(2,4-Dichloro-5-methoxyphenyl)amino]-6-methoxy-7-[3-(4-propyl-1-piperazinyl)propoxy]-3-quinolinecarbonitrile; and pharmaceutically acceptable salts thereof.

According to a particular embodiment, the agent which possesses inhibitory activity against the Src family kinase is a small molecule agent.

According to a particular embodiment, the agent which possesses inhibitory activity against the Src family kinase is a chemical agent.

Suitable compounds possessing inhibitory activity against the Src family of non-receptor tyrosine kinases include the quinazoline derivatives disclosed in International Patent Applications WO 01/94341, WO 02/16352, WO 02/30924, WO 02/30926, WO 02/34744, WO 02/085895, WO 02/092577 (arising from PCT/GB 02/02117), WO 02/092578 (arising from PCT/GB 02/02124) and WO 02/092579 (arising from PCT/GB 02/02128), the quinoline derivatives described in WO 03/008409 (arising from PCT/GB 02/03177), WO 03/047584 and WO 03/048159 and the quinazoline derivatives described in European Patent Applications 02292736.2 (filed 4 Nov. 2002) and 03290900.4 (filed 10 Apr. 2003).

It is disclosed in Journal Medicinal Chemistry, 2001, 44, 822-833 and 3965-3977 that certain 4-anilino-3-cyanoquinoline derivatives are useful for the inhibition of Src-dependent cell proliferation. The 4-anilino-3-cyanoquinoline Src inhibitor known as SKI 606 is described in Cancer Research, 2003, 63, 375.

Other compounds which possess Src kinase inhibitory properties are described in, for example, International Patent Applications WO 96/10028, WO 97/07131, WO 97/08193, WO 97/16452, WO 97/28161, WO 97/32879 and WO 97/49706.

Other compounds which possess Src kinase inhibitory properties are described in, for example, J Bone Mineral Research, 1999, 14 (Suppl. 1), S487, Molecular Cell, 1999, 3, 639-647, Journal Medicinal Chemistry, 1997, 40, 2296-2303, Journal Medicinal Chemistry, 1998, 41, 3276-3292 and Bioorganic & Medicinal Chemistry Letters, 2002, 12, 1361 and 3153.

Particular Src kinase inhibitors include the following:
(i) 4-amino-5-(3-methoxyphenyl)-7-{(4-[2-(2-methoxyethylamino)ethoxy]phenyl)-}-pyrrolo[2,3-d]pyrimidine and 4-amino-5-(3-methoxyphenyl)-7-(4-{(2-[di-(2-methoxyethyl)amino]ethoxy}phenyl)pyrrolo[2,3-d]pyrimidine which are obtainable by methods described in International Patent Application WO 96/10028:

(ii) 4-amino-7-tert-butyl-5-(4-tolyl)pyrazolo[3,4-d]pyrimidine which is also known as PP1 and is described in Molecular Cell, 1999, 3, 639-648;

(iii) 2-(2,6-dichloroanilino)-6,7-dimethyl-1,8-dihydroimidazo[4,5-h]isoquinolin-9-one and 2-(2,6-dichloroanilino)-7-[(E)-3-diethylaminoprop-1-enyl]-6-methyl-1,8-dihydroimidazo[4,5-h]isoquinolin-9-one which are obtainable by methods described in Journal Medicinal Chemistry, 2002, 45, 3394;

(iv) 1-[6-(2,6-dichlorophenyl)-2-(4-diethylaminobutyl)pyrido[2,3-d]pyrimidin-7-yl]-3-ethylurea which is obtainable by methods described in Journal Medicinal Chemistry, 1997, 40, 2296-2303 and Journal Medicinal Chemistry, 2001, 44, 1915;

(v) 6-(2,6-dichlorophenyl)-2-[4-(2-diethylaminoethoxy)anilino]-8-methyl-8H-pyrido[2,3-d]pyrimidin-7-one which is also known as PD166285 and is described in J. Pharmacol. Exp. Ther., 1997, 283, 1433-1444;

(vi) the compound known as PD 162531 which is described in Mol. Biol. Cell, 2000, 11, 51-64;

(vii) the compound known as PD166326 which is described in Biochem Pharmacol., 2000, 60, 885-898; and (viii) the compound known as PD173955 which is described in Cancer Research, 1999, 59, 6145-6152.

Other compounds which may possess Src kinase inhibitory properties are described in, for example, International Patent Applications WO 02/079192, WO 03/000188, WO 03/000266, WO 03/000705, WO 02/083668, WO 02/092573, WO 03/004492, WO 00/49018, WO 03/013541, WO 01/00207, WO 01/00213 and WO 01/00214.

Particular Src inhibitors include those provided in International Patent Application WO 01/94341.

Further particular Src inhibitors include the following compounds from International Patent Application WO 02/16352, WO 02/30924, WO 02/30926 and WO 02/34744. Exemplary agents include, without limitation, dasatinib, and AZD0530.

Other exemplary agents include CGP77675 (AXON MEDCHEM 2097), SU 6656, AZD0530, Dasatinib, Bosutinib and WH-4-023.

According to some embodiments of the invention, the Src family kinase inhibitor (e.g. CGP77675) is provided at a concentration range of between about 0.1-100 µM, e.g., 0.1-70 µM, e.g., from about 0.2 µM to about 70 µM, e.g., between about 0.2-60 µM, e.g., between about 0.2-55 µM, e.g., between about 0.2-50 µM, e.g., between about 0.2-45 µM, e.g., between about 0.2-40 µM, e.g., between about 0.2-35 µM, e.g., between about 0.2-30 µM, e.g., between about 0.2-25 µM, e.g., between about 0.2-20 µM, e.g., between about 0.2-15 µM, e.g., between about 0.2-10 µM, e.g., between about 0.3-10 µM, e.g., between about 0.4-10 µM, e.g., between about 0.5-10 µM, e.g., between about 0.6-10 µM, e.g., between about 0.7-10 µM, e.g., between 0.8-10 µM, e.g., between 0.9-10 µM, e.g., between 0.9-9 µM, e.g., between 1-8 µM, e.g., between 1-7 µM, e.g., between 1-6 µM, e.g., between 1-5 µM, e.g., about 1-3 µM, e.g., about 1.5 µM.

Ascorbic acid (also known as vitamin C) is a sugar acid ($C_6H_8O_6$; molecular weight 176.12 grams/mole) with antioxidant properties. The ascorbic acid used by the culture medium of some embodiments of the invention can be a natural ascorbic acid, a synthetic ascorbic acid, an ascorbic acid salt (e.g., sodium ascorbate, calcium ascorbate, potassium ascorbate), an ester form of ascorbic acid (e.g., ascorbyl palmitate, ascorbyl stearate), a functional derivative thereof (a molecule derived from ascorbic acid which exhibits the same activity/function when used in the culture medium of the invention), or an analogue thereof (e.g., a functional equivalent of ascorbic acid which exhibits an activity analogous to that observed for ascorbic acid when used in the culture medium of the invention). Non-limiting examples of ascorbic acid formulations which can be used in the culture medium of some embodiments of the invention include L-ascorbic acid and ascorbic acid 3-phosphate.

Ascorbic acid can be obtained from various manufacturers such as Sigma, St Louis, MO, USA (e.g., Catalogue numbers: A2218, A5960, A7506, A0278, A4403, A4544, A2174, A2343, 95209, 33034, 05878, 95210, 95212, 47863, 01-6730, 01-6739, 255564, A92902, W210901).

The concentration of ascorbic acid comprised in the culture medium of some embodiments of the invention is between about 1 µg/ml up to 200 µg/ml, e.g., between 10-150 µg/ml, e.g., between 10-100 µg/ml, e.g., between 10-60 µg/ml, e.g., 20-60 µg/ml, e.g., 30-60 µg/ml, e.g., 50 µg/ml.

As used herein the term "PKA" refers to Protein Kinase A (PKA), which is also known as cAMP-dependent protein kinase, e.g., as set forth by GenBank Accession Nos. NP_001229786.1 (SEQ ID NO:137), NP_001229787.1 (SEQ ID NO:138), NP_001229788.1 (SEQ ID NO:139), NP_001229789.1 (SEQ ID NO:140), NP_001229790.1 (SEQ ID NO:141), NP_001229791.1 (SEQ ID NO:142), NP_002722.1 (SEQ ID NO:143), NP_891993.1 (SEQ ID NO:144), NP_997461.1 (SEQ ID NO:145), NP_002721.1 (SEQ ID NO:146) and NP_997401.1 (SEQ ID NO:147).

The phrase "PKA agonist" as used herein refers to any molecule (e.g., a small molecule, a peptide, an RNA, a cDNA) which increases the level and/or activity of PKA. For example, an RNA or cDNA encoding the PKA protein (or at least the catalytic domain thereof) can be used to increase the level and/or activity of PKA. Additionally or alternatively, an agonist of PKA can be also cyclic AMP (cAMP), which binds to PKA and activates it. Additionally or alternatively, an agonist of PKA can be any activator of the enzyme Adenylate Cyclase which catalyzes the conversion of adenosine triphosphate (ATP) to 3',5'-cyclic AMP (cAMP) and pyrophosphate, and accordingly, increases the level of cAMP. Non-limiting examples of PKA agonists which can be used in the culture medium of some embodiments of the invention include Forskolin and AICAR.

According to some embodiments of the invention, the concentration of Forskolin comprised in the culture medium of some embodiments of the invention is between about 0.1 µM to 20 µM, e.g., about 0.5 µM to about 15 µM, e.g., about 1 µM to about 10 µM, e.g., about, 2-8 µM, e.g., about 4-6 µM.

As used herein the term "YAP" or "YAP1", which are interchangeably used herein, refers to the "Yes-associated protein 1". As used herein the term "TAZ" refers to Tafazzin.

As used herein the term "YAP/TAZ inhibitor" refers to any molecule capable of inhibiting the function of "YAP" and/or "TAZ". Examples include, but are not limited to, Verteporfin (VP), which can be included at a concentration of about 0.1 µM to about 10 µM; and 9E1, which can be included at a concentration of about 0.1 µM to about 5 µM.

Further information regarding the Verteporfin can be obtained from Johnson R. and Halder G. 2014 ("The two faces of Hippo: targeting the Hippo pathway for regenerative medicine and cancer treatment". Nat. Rev. Drug Discov. 13(1):63-79. doi: 10.1038/nrd4161. Epub 2013 Dec. 13. Review; which is fully incorporated herein by reference in its entirety). Members of the Notch family of Type 1 transmembrane proteins share structural characteristics including an extracellular domain consisting of multiple epidermal growth factor-like (EGF) repeats, and an intracellular domain consisting of multiple, different domain types. Notch family members play a role in a variety of developmental processes by controlling cell fate decisions. The Notch signaling network is an evolutionarily conserved intercellular signaling pathway which regulates interactions between physically adjacent cells. In humans, the Notch family includes notch 1 [GenBank Accession No. XP_011517019.1 (SEQ ID NO:184)], which is cleaved in the trans-Golgi network, and presented on the cell surface as a heterodimer; notch 2 [GenBank Accession Nos. NP_077719.2 isoform 1 (SEQ ID NO:185) and NP_001186930.1 isoform 2 (SEQ ID NO:186)], which is cleaved in the trans-Golgi network, and presented on the cell surface as a heterodimer; notch 3 [GenBank Accession No. NP_000426.2 (SEQ ID NO:187)]; and notch 4 [GenBank Accession No. NP_004548.3 (SEQ ID NO:188)], which is cleaved in the trans-Golgi network, and presented on the cell surface as a heterodimer.

NOTCH signaling inhibitors include, but are not limited to the following gamma secretase inhibitors: DAPT (Axon Medchem 1484-0.05-50 microM final concentration), LY2886721 hydrochloride (Axon Medchem 1964-0.05-50 microM final concentration)], DBZ (Axon Medchem—Axon 1488-0.05-50 microM final concentration).

Sonic Hedgehog pathway (SHH) protein [GenBank Accession NO. NP_000184.1, SEQ ID NO: 189] is instrumental in patterning the early embryo. It has been implicated as the key inductive signal in patterning of the ventral neural tube, the anterior-posterior limb axis, and the ventral somites. The protein is made as a precursor that is autocatalytically cleaved; the N-terminal portion is soluble and contains the signalling activity while the C-terminal portion is involved in precursor processing. More importantly, the C-terminal product covalently attaches a cholesterol moiety to the N-terminal product, restricting the N-terminal product to the cell surface and preventing it from freely diffusing throughout the developing embryo.

Sonic Hedgehog pathway (SHH) inhibitors include, but are not limited to the following: GANT61 (SigmaAldrich—0.05-50 microM final concentration), RU-SKI 43 (Axon Medchem—Axon 2035-0.05-50 microM final concentration)].

As used herein the term "transforming growth factor receptor (TGFR)" (also known as "TGFβR") refers to TGF-β type I receptor ALK5, type I activin/nodal receptor ALK4 and type I nodal receptor ALK7.

As used herein the term "TGFR inhibitor (or TGFRi)" refers to a molecule capable of inhibiting TGFR expression and/or activity level as determined by phosphorylated ALK4, 5 and 7.

Non-limiting examples of TGFR inhibitors include SB431542 and A 83-01 small molecule compound.

According to some embodiments of the invention, the TGFR inhibitor is provided at a concentration range of about 0.1-30 µM, e.g., about 1-30 µM, e.g., 5-25 µM, e.g., 5-10 µM, e.g., 0.1-5 µM, e.g., 0.2-4 µM, e.g., 0.5-3 µM.

BMP (bone morphogenic protein) signaling inhibitors include, but are not limited to: LDN193189 (AXON 1509—0.01-20 microM final concentration, e.g. 0.2 microM), K02288 (Axon 2189; 0.1-20 microM final concentration), Dorsomorphin hydrochloride (AXON 2150 0.1-20 microM final concentration).

As used herein the term "fibroblast growth factor receptor (FGFR)" refers to FGFR1, FGFR2 and FGFR3.

As used herein the term "FGFR inhibitor (or FGFRi)" refers to a molecule capable of inhibiting FGFR expression and/or activity level as determined by levels of phosphorylated FGFR1, 2, and 3.

Non-limiting examples of FGFR inhibitors include PD173074 and SU5401.

According to some embodiments of the invention, the FGFR inhibitor (FGFRi) is PD173074 and is provided in a concentration range between about 0.01-40 µM, e.g., between about 0.02-40 µM, e.g., between about 0.05-40 µM, e.g., between, about 0.1-40 µM, about 0.5-40 µM, about 1-40 µM, e.g., about 2-40 µM, about 5-40 µM, about 10-40 µM, e.g., between about 0.05-5 µM, e.g., about 0.1-5 µM.

According to some embodiments of the invention, the FGFR inhibitor (FGFRi) is SU5401 and is provided at a concentration range of about 0.1-40 µM, e.g., about 0.5-40 µM, about 1-40 µM, e.g., about 2-40 µM, about 5-40 µM, about 10-40 µM.

As described above, the culture medium includes an ERK1/2 inhibitor (ERK1/2i). It should be noted that ERK1/2 inhibitors belong to a family of MAPK inhibitor(s), which also includes JNK inhibitor(s) (JNKi), ERK5 inhibitor(s) (ERK5i; e.g., BIX02189), BRAF inhibitor(s) (BRAFi; e.g., SB590885), ARAF inhibitor(s) (ARAFi), CRAF inhibitor(s) (CRAFi), and p38 inhibitor(s) (p38i; e.g., BIRB796, AXONMEDCHEM—Axon 1358).

According to some embodiments of the invention, the medium of some embodiments of the invention further comprises an inhibitor selected from the group consisting of a JNK inhibitor, an ERK5 inhibitor (e.g., BIX02189), a BRAF inhibitor (e.g., SB590885), ARAFi, CRAFi, and a p38 inhibitor (e.g., BIRB796, AXONMEDCHEM—Axon 1358).

As used herein the term "JNK" refers to the mitogen-activated protein kinase 8 (MAPK8) protein set forth by GenBank Accession Nos. NP_620637.1 (isoform alpha2) (SEQ ID NO:46), NP_620635.1 (isoform beta2) (SEQ ID NO:47), NP_620634.1 (isoform beta1) (SEQ ID NO:48), NP_002741.1 (isoform alpha1) (SEQ ID NO:49) which are involved in a wide variety of cellular processes such as proliferation, differentiation, transcription regulation and development.

As used herein the term "JNK inhibitor" refers to any molecule capable of inhibiting the activity of JNK as determined by phosphorylation of JNK family member protein by western blot analysis. Examples include, but are not limited to SP600125 (TOCRIS—Cat no. 1496), and AEG3482 (AXONMEDCHEM—AXON 1291, e.g., at a concentration of 0.1 µM-10 µM).

According to some embodiments of the invention, SP600125 is provided at a concentration range of between about 0.5-100 µM, e.g., from about 1 µM to about 100 µM, e.g., between about 1-90 µM, e.g., between about 1-80 µM, e.g., between about 1-70 µM, e.g., between about 1-60 µM, e.g., between about 1-55 µM, e.g., between about 1-50 µM, e.g., between about 1-45 µM, e.g., between about 1-40 µM, e.g., between about 1-35 µM, e.g., between about 1-30 µM, e.g., between about 1-25 µM, e.g., between about 1-20 µM, e.g., between about 1-15 µM, e.g., between about 1-10 µM, e.g., between about 2-10 µM, e.g., between about 3-10 µM, e.g., between about 4-10 µM, e.g., between about 4-6 µM, e.g., about 5 µM.

According to some embodiments of the invention, the ERK5 inhibitor, e.g., BIX02189, is provided at a concentration range of between about 0.5-100 µM, e.g., from about 1 µM to about 100 µM, e.g., between about 1-90 µM, e.g., between about 1-80 µM, e.g., between about 1-70 µM, e.g., between about 1-60 µM, e.g., between about 1-55 µM, e.g., between about 1-50 µM, e.g., between about 1-45 µM, e.g., between about 1-40 µM, e.g., between about 1-35 µM, e.g., between about 1-30 µM, e.g., between about 1-25 µM, e.g., between about 1-20 µM, e.g., between about 1-15 µM, e.g., between about 1-10 µM, e.g., between about 2-10 µM, e.g., between about 3-10 µM, e.g., between about 4-10 µM, e.g., between about 4-6 µM, e.g., about 5 µM.

As described, the culture medium of some embodiments of the invention may also comprise a RAF kinase inhibitor.

RAF kinase is a serine/threonine kinase that functions in the MAP kinase signaling pathway. The RAF kinase proteins which are inhibited by the RAF inhibitor used in the medium of some embodiments of the invention include ARAF [A-Raf proto-oncogene, serine/threonine kinase; isoform 1 (GenBank Accession No. NP_001645.1, SEQ ID NO:190); isoform 2 (GenBank Accession No. NP_001243125.1, SEQ ID NO:191); and isoform 3 (GenBank Accession No. NP_001243126.1, SEQ ID NO:192)], BRAF [B-Raf proto-oncogene serine/threonine kinase, GenBank Accession No. NP_004324.2 (SEQ ID NO:193)] and RAF1 [also known as CRAF, or c-Raf; Raf-1 proto-oncogene serine/threonine kinase, GenBank Accession No. NP_002871.1 (SEQ ID NO:194)].

RAF inhibitors are, e.g., compounds which inhibit wild-type C-Raf at an $IC_{50}$ of from 0.05 mmol/L to more than 4.0 mmol/L.

Exemplary RAF kinase inhibitors are disclosed in WO 00/09495 and WO 05/028444, the contents of which are incorporated herein by reference.

Examples of RAF kinase inhibitors include (4-tert-butyl-phenyl)-4-pyridin-4-ylmethyl-isoquinolin-1-yl)-amine; [4,7]biisoquinolinyl-1-yl-4-(tert-butyl-phenyl)-amine; (4-tert-butyl-phenyl)-(4-quinazolin-6-yl-isoquinolin-1-yl)-amine; [4,7]biisoquinolinyl-1-yl-(2-tert butyl-pyrimidin-5-yl)-amine.

A non-limiting example of a RAF inhibitor, which is more specific for C-Raf, but also has also an inhibitory activity against B-RAF is Sorafenib.

According to some embodiments of the invention, Sorafenib is provided at a concentration range from about 0.1 microM (µM) to about 70 µM, e.g., between about 0.1-60 µM, e.g., between about 0.1-50 µM, e.g., between about 0.5-50 µM, e.g., between about 0.5-45 µM, e.g., between about 0.5-40 µM, e.g., between about 0.1-35 µM, e.g., between about 0.5-30 µM, e.g., between about 0.5-25 µM, e.g., between about 0.5-20 µM, e.g., between about 0.5-15 µM, e.g., between about 0.5-10 µM, e.g., between 0.5-9 µM, e.g., between 0.5-8 µM, e.g., between 0.5-7 µM, e.g., between 0.9-6 µM, e.g., between 0.8-5 µM, e.g., about 5 µM, e.g., between 0.8-4 µM, e.g., between 0.8-3 µM, e.g., between 0.8-2 µM, e.g., between 0.8-1.5 µM, e.g., between 0.9-1.2 µM.

According to some embodiments of the invention, BRAFi (e.g., SB590885) is provided at a concentration range of between about 0.1-100 µM, e.g., between about 0.1-90 µM, e.g., between about 0.1-80 µM, e.g., between about 0.1-70 µM, e.g., between about 0.1-60 µM, e.g., between about 0.1-50 µM, e.g., between about 0.1-40 µM, e.g., between about 0.1-30 µM, e.g., between about 0.1-20 µM, e.g., between about 0.1-10 µM, e.g., between about 0.1-5 µM, e.g., between about 0.1-2 µM, e.g., between about 0.1-1 µM, e.g., about 0.5 µM.

As used herein the term "p38" refers to the "p38a (alpha)" mitogen-activated protein kinase 14 (MAPK14), which includes MAPK14 isoform 1 set forth by GenBank Accession No. NP_001306.1 (SEQ ID NO:39), MAPK14 isoform 2 set forth by GenBank Accession No. NP_620581.1 (SEQ ID NO:40), MAPK14 isoform 3 set forth by GenBank Accession No. NP_620582.1 (SEQ ID NO:41) and MAPK14 isoform 4 set forth by GenBank Accession No. NP_620583.1 (SEQ ID NO:42); "p38β (beta)" (MAPK11), which is set forth by GenBank Accession No. NP_002742.3 (SEQ ID NO:43); "p38γ (gamma)" (MAPK12) which is set forth by GenBank Accession No. NP_002960.2 (SEQ ID NO:44); and/or "p38δ (delta)" (MAPK13) which is set forth in GenBank Accession No. NP_002745.1 (SEQ ID NO:45), all of them having kinase activity and involved in signal transduction.

As used herein the term "p38 inhibitor" refers to any molecule (e.g., small molecules or proteins) capable of inhibiting the activity of p38 family members as determined by Western blot quantification of phosphorylated p38 levels.

Non-limiting examples of p38 inhibitors include SB203580 (AXONMEDCHEM—Axon 1363), and SB 202190 (AXONMEDCHEM—Axon 1364), LY 2228820 (AXONMEDCHEM—Axon 1895), BIRB796 (Axon Medchem 1358) and PD169316 (AXONMEDCHEM—Axon 1365, e.g., at a concentration of about 0.1 µM to about 10 µM).

As BMP signaling is an activator for p38 signaling, examples of p38 inhibitors also include BMP inhibitors like Dorsomorphin (AXONMEDCHEM—Axon 2150) and LDN193189 (AXON MEDCHEM AXON 1509) or other inhibitors of the BMP pathway such as recombinant NOG-GIN protein [GenBank Accession No. NP_005441.1 (SEQ ID NO: 118)] can be used to replace small molecule inhibitors of BMP signaling.

According to some embodiments of the invention, SB203580 is provided at a concentration range of between about 0.5-70 µM, e.g., from about 1 µM to about 70 µM, e.g., between about 1-60 µM, e.g., between about 1-55 µM, e.g., between about 1-50 µM, e.g., between about 1-45 µM, e.g., between about 1-40 µM, e.g., between about 1-35 µM, e.g., between about 1-30 µM, e.g., between about 1-25 µM, e.g., between about 1-20 µM, e.g., between about 1-15 µM, e.g., between about 1-10 µM, e.g., between about 2-10 µM, e.g., between about 3-10 µM, e.g., between about 4-10 µM, e.g., between about 4-6 µM, e.g., about 5 µM, e.g., about 10 µM.

According to some embodiments of the invention, SB 202190 is provided at a concentration range of between about 0.1 µM to about 50 µM, e.g., from about 0.5 µM to about 50 µM, e.g., from about 1 µM to about 50 µM, e.g., between about 1-45 µM, e.g., between about 1-40 µM, e.g., between about 1-35 µM, e.g., between about 1-30 µM, e.g., between about 1-25 µM, e.g., between about 1-20 µM, e.g., between about 1-15 µM, e.g., between about 1-10 µM, e.g., between about 1-9 µM, e.g., between about 1-8 µM, e.g., between about 1-7 µM, e.g., between about 2-7 µM, e.g., between about 3-7 µM, e.g., between about 4-7 µM, e.g., between about 4-6 µM, e.g., about 5 µM.

According to some embodiments of the invention, BIRB796 is provided at a concentration range of between about 0.05 to about 30 µM, e.g., from about 0.1 to about 30 µM, e.g., between about 0.2-30 µM, e.g., between about 0.2-25 µM, e.g., between about 0.2-20 µM, e.g., between about 0.2-15 µM, e.g., between about 0.2-10 µM, e.g., between about 0.2-8 µM, e.g., between about 0.2-6 µM, e.g., between about 0.5-6 µM, e.g., between about 0.5-5 µM, e.g., between about 0.5-4 µM, e.g., between about 0.5-3 µM, e.g., between about 0.5-2 µM, e.g., between about 1-3 µM, e.g., between about 1-2.5 µM, e.g., about 2 µM, e.g., about 0.1 µM, e.g., about 1 µM.

As used herein, the term "LSD1" refers to the lysine (K)-specific demethylase 1A (Gene ID KDM1A) nuclear protein that is a component of several histone deacetylase complexes. The protein contains a SWIRM domain, a FAD-binding motif, and an amine oxidase domain, and it silences genes by functioning as a histone demethylase.

Non-limiting examples of LSD1 inhibitors include, but are not limited to Tranylcypromine (TCP), at a concentration between about 0.1 µM to about 10 µM, e.g., at about 5 µM.

Examples of PI3K boosters include for example insulin-like growth factor 1 (IGF1; e.g., at a range 0.1-100 ng/ml final concentration), insulin-like growth factor II (IGFII; e.g., at a range 0.1-100 ng/ml final concentration), stem cell factor (SCF; e.g., at a range 0.1-100 ng/ml final concentration) and FGF2.

The term "insulin-like growth factor 1 (IGF1)" refers to any of the insulin-like growth factor isoforms 1-4 as set forth in GenBank Accession Nos. NP_001104753.1 (SEQ ID NO:162), NP_001104754.1 (SEQ ID NO:164), NP_001104755.1 (SEQ ID NO:166) and NP_000609.1 (SEQ ID NO:160), which are encoded by GenBank Accession Nos. NM_001111283.1 (SEQ ID NO:163), NM_001111284.1 (SEQ ID NO:165), NM_001111285.1 (SEQ ID NO:167) and NM_000618.3 (SEQ ID NO:161), respectively.

The term "insulin-like growth factor 2 (IGF2)" refers to isoform 1 (encoded by variants 1, 2, 4 and 5) and isoform 2 (encoded by variant 3) of the insulin like growth factor II. Variant 1 represents the most predominant transcript [GenBank Accession Nos. NM_000612.5 (SEQ ID NO:169) and NP_000603.1 (SEQ ID NO:168)]. Variant 2 contains two alternate 5' non-coding exons, therefore, has a different 5' UTR compared to variant 1 [GenBank Accession Nos. NM_001007139.5 (SEQ ID NO:171) and NP_001007140.2 (SEQ ID NO:170)]. Variant 3 contains two alternate exons at the 5' end, one non-coding and another coding, compared to variant 1. This results in the use of an upstream AUG (not found in variants 1 and 2) and a longer isoform (2) with a distinct N-terminus compared to isoform 1 [GenBank Accession Nos. NM_001127598.2 (SEQ ID NO:173) and NP_001121070.1 (SEQ ID NO:172)]. Variant (4) differs in the 5' UTR exon, compared to variant 1 [GenBank Accession Nos. NM_001291861.2 (SEQ ID NO:175) and NP_001278790.1 (SEQ ID NO:174)]. This variant (5) differs in the 5' UTR exon, compared to variant 1 [GenBank Accession Nos. NM_001291862.2 (SEQ ID NO:177) and NP_001278791.1 (SEQ ID NO:176)].

The term "stem cell factor" or "SCF", which is interchangeably used herein, refers to the ligand of the tyrosine-kinase receptor encoded by the KIT locus. (also known as "KIT ligand" or "KITLG"), e.g., the kit ligand isoform b precursor set forth in GenBank Accession No. NP_000890.1 (SEQ ID NO: 156) which is encoded by GenBank Accession No. NM_000899.4 (SEQ ID NO:157), and kit ligand isoform a precursor set forth in GenBank Accession No. NP_003985.2 (SEQ ID NO:158), which is encoded by GenBank Accession No. NM_003994.5 (SEQ ID NO:159).

According to a particular embodiment, the PI3K booster is FGF2.

The phrases "basic fibroblast growth factor (bFGF)" or "FGF2" which are interchangeably used herein refer to a polypeptide of the fibroblast growth factor (FGF) family, which bind heparin and possess broad mitogenic and angiogenic activities. The mRNA for the BFGF gene contains multiple polyadenylation sites, and is alternatively translated from non-AUG (CUG) and AUG initiation codons, resulting in five different isoforms with distinct properties. The CUG-initiated isoforms are localized in the nucleus and are responsible for the intracrine effect, whereas, the AUG-initiated form is mostly cytosolic and is responsible for the paracrine and autocrine effects of this FGF.

According to some embodiments of the invention, the bFGF used by the medium of some embodiments of the invention is provided in GenBank Accession No. NP_001997 (SEQ ID NO:29). BFGF can be obtained from various manufacturers such as Peprotech, RnD systems, Millipore. According to some embodiments of the invention, the bFGF used by the medium of some embodiments of the invention is provided from R&D Systems (Catalog Number: 233-FB).

According to some embodiments of the invention, bFGF is provided at a concentration range from about 0.5 nanogram per milliliter (ng/ml) to about 500 ng/ml, e.g., about 1-500 ng/ml, e.g., about 1-400 ng/ml, e.g., about 1-300 ng/ml, e.g., about 1-200 ng/ml, e.g., about 1-100 ng/ml, e.g., about 1-80 ng/ml, e.g., about 1-70 ng/ml, e.g., about 1-70 ng/ml, e.g., about 1-60 ng/ml, e.g., about 1-50 ng/ml, e.g., about 1-40 ng/ml, e.g., about 1-30 ng/ml, e.g., about 1-20 ng/ml, e.g., about 2-20 ng/ml, e.g., about 2-10 ng/ml, e.g., about 3-10 ng/ml, e.g., about 4-10 ng/ml, e.g., about 8 ng/ml.

As used herein the term "SMAD" refers to a family of proteins which are phosphorylated and activated by trans-membrane serine-threonine receptor kinases in response to TGF-beta signaling. It should be noted that potential SMAD activators are the TGFβ cytokines.

According to some embodiments of the invention, the SMAD activator is selected from the group consisting of Activin A, TGFβ1, and bone morphogenetic protein 4 (BMP4).

Transforming growth factor (TGF) inducers include for example, TGFβ1, TGFβ2 and Activin.

According to a particular embodiment, the Transforming growth factor (TGF) inducer is TGF 31.

As used herein the phrase "TGFβ1" refers to an isoform beta-1 (β1) of the transforming growth factor beta (e.g., *Homo sapiens* TGFβ$_1$, GenBank Accession No. NP_000651; SEQ ID NO:28, which is encoded by the sequence depicted in GenBank Accession No. NM_000660.5; SEQ ID NO:31). TGFβ acts in inducing transformation and also acts as a negative autocrine growth factor. TGFβ1 isoform can be obtained from various commercial sources such as R&D Systems Minneapolis MN, USA.

According to some embodiments of the invention, TGFβ1 is provided at a concentration range from about 0.1 nanogram per milliliter (ng/ml) to about 500 ng/ml, e.g., about 0.1-400 ng/ml, e.g., about 0.1-300 ng/ml, e.g., about 0.1-200 ng/ml, e.g., about 0.1-100 ng/ml, e.g., about 0.1-50 ng/ml, e.g., about 0.1-30 ng/ml, e.g., about 0.1-20 ng/ml, e.g., about 0.1-10 ng/ml, e.g., about 1-10 ng/ml, e.g., about 0.1-8 ng/ml, e.g., about 0.1-7 ng/ml, e.g., about 0.1-6 ng/ml, e.g., about 0.1-5 ng/ml, e.g., about 0.1-4 ng/ml, e.g., about 0.1-3 ng/ml, e.g., about 0.1-2 ng/ml, e.g., about 0.5-2 ng/ml, e.g., about 0.5-1.5 ng/ml, e.g., about 1 ng/ml.

According to some embodiments of the invention, activators of TGF/ACTIVIN pathway including ACTIVIN A (also known as Inhibin beta A, INHBA, Gene ID: 3624; GenBank Accession No. NM_002192.2 (SEQ ID NO:123), which encodes GenBank Accession No. NP_002183.1; SEQ ID NO:117) can be used to replace TGFβ1.

According to some embodiments of the invention, the TGFβ1 cytokine can be replaced with recombinant Nodal and/or Activin, and/or transforming growth factor beta 2 (TGFβ2) and/or GDF3 and/or GDF-9.

According to some embodiments of the invention, the concentration of Activin A in the culture medium of some embodiments of the invention is about 1-40 ng/ml, e.g., about 20 ng/ml.

As used herein the term "BMP4" refers to a member of the bone morphogenetic protein family [GenBank Accession No. NP_001193.2 (SEQ ID NO: 148)] which is part of the transforming growth factor-beta superfamily. The superfamily includes large families of growth and differentiation factors. BMP4 plays an important role in the onset of endochondral bone formation in humans, and a reduction in expression has been associated with a variety of bone diseases.

According to some embodiments of the invention, the concentration of the BMP4 protein in the culture medium is between about 0.1 ng/ml to about 20 ng/ml, e.g., between about 5-10 ng/ml.

As used herein the term "DOT1L" [DOT1-like histone H3K79 methyltransferase protein; GenBank Accession No. NP_115871.1 (SEQ ID NO:149)] refers to a histone methyltransferase that methylates lysine-79 of histone H3. DOT1L is inactive against free core histones, but shows significant histone methyltransferase activity against nucleosomes.

Non-limiting examples of DOT1L inhibitors include, but are not limited to SGC0946.

According to some embodiments of the invention, the concentration of SGC0946 in the culture medium is between about 0.05 µM to about 10 µM, e.g., at a concentration of about 0.1 to about 10 µM, e.g., about 1 µM, e.g., about 2 µM, e.g., about 5 µM.

According to some embodiments of the invention, the medium further comprises an inhibitor of G9a [also known as "EHMT2 euchromatic histone-lysine N-methyltransferase 2" GenBank Accession Nos. NP_001276342.1 (isoform a; SEQ ID NO:197), NP_079532.5 (isoform b; SEQ ID NO:198), NP_001276342.1 (isoform c; SEQ ID NO:199)] and/or G1p (also known as "EHMT1 euchromatic histone-lysine N-methyltransferase 1" GenBank Accession Nos. NP_079033.4 (isoform 1; SEQ ID NO: 200) and NP_001138999.1 (isoform 2; SEQ ID NO:201)], which form part of the H3K9me2 [dimethylation (me2) of Lys (K) 9 on histone H3] (Kubicek S1, O'Sullivan R J, et al., Reversal of H3K9me2 by a small-molecule inhibitor for the G9a histone methyltransferase. Mol Cell. 2007, 25(3):473-81; and Vedadi M1, Barsyte-Lovejoy D, et al. A chemical probe selectively inhibits G9a and GLP methyltransferase activity in cells. Nat. Chem. Biol. 2011, 7(8):566-74; each of which is fully incorporated herein by reference in its entirety). Protein lysine methyltransferases G9a and GLP modulate the transcriptional repression of a variety of genes via dimethylation of Lys9 on histone H3 (H3K9me2) as well as dimethylation of non-histone targets.

According to some embodiments of the invention, the inhibitor can selectively impair the G9a histone lysine methyltransferase (HMTase) activity and/or the generation of H3K9me2 in vitro.

A non-limiting example of an inhibitor of G9a and/or G1p which can be used in the culture medium of some embodiments of the invention include for example an siRNA or antisense RNA which knockdowns the level of G9a and/or GLP RNA or protein product.

A non-limiting example of an inhibitor of G9a and/or G1p which can be used in the culture medium of some embodiments of the invention include for example a small molecule which specifically inhibits the activity of G9a and/or G1p, and/or prevents or impairs generation of the H3K9me2.

According to some embodiments of the invention the small molecule that inhibits G9a and/or G1p, and/or prevents or impairs generation of the H3K9me2 is BIX-01294 (diazepin-quinazolin-amine derivative) and/or UNC0638.

According to some embodiments of the invention the small molecule that inhibits G9a and/or G1p, and/or prevents or impairs generation of the H3K9me2 is BIX-01294 (also referred to hereinbelow as "BIX01294").

According to some embodiments of the invention the concentration of BIX01294 in the culture medium is between about 0.05 microM to about 5 microM, e.g., between 0.05 microM (µM) to about 4 µM, e.g., between about 0.08-3 µM, e.g., between about 0.1-3 µM, e.g., between about 0.1-2 µM, e.g., between about 0.1-1 µM, e.g., between about 0.2-1 µM, e.g., between about 0.3-1 µM, e.g., between about 0.4-1 µM, e.g., between about 0.4-0.8 µM, e.g., between about 0.4-0.6 µM, e.g., between about 0.5-0.6 µM, e.g., about 0.5 microM.

According to some embodiments of the invention, the concentration of BIX01294 in the culture medium is between about 0.05 µM to about 5 µM.

According to some embodiments of the invention the concentration of UNC0638 in the culture medium is between about 0.01 µM to about 5 µM, e.g., between 0.02-5 µM, e.g., between 0.04-5 µM, e.g., between 0.06-5 µM, e.g., between 0.05 microM (µM) to about 4 µM, e.g., between about 0.08-3 µM, e.g., between about 0.08-2 µM, e.g., between about 0.08-1 µM, e.g., between about 0.08-0.5 µM, e.g., between about 0.1-1 µM, e.g., between about 0.1-0.8 µM, e.g., between about 0.1-0.6 µM, e.g., between about 0.1-0.4 µM, e.g., between about 0.1-0.3 µM, e.g., between about 0.1-0.2 µM, e.g., about 0.1 microM.

According to some embodiments of the invention, the medium further comprises an at least one agent selected from the group consisting of: basic fibroblast growth factor (bFGF), transforming growth factor beta 1 (TGFβ1), ACTIVIN A, a GSK3b inhibitor, a ROCK inhibitor, a P38 inhibitor, a JNK inhibitor, a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, G9a and/or G1p inhibitor (e.g., BIX01294 or UNC0638), stem cell factor (SCF), YAP/TAZ inhibitor, L-Ascorbic Acid, LSD1 inhibitor and DOT1L inhibitor.

According to some embodiments of the invention, the concentration of BayK8644 in the culture medium is between about 0.5 µM to about 10 µM.

According to some embodiments of the invention, the medium further comprises an at least one agent selected from the group consisting of: a transforming growth factor receptor (TGFR) inhibitor, a fibroblast growth factor receptor (FGFR) inhibitor, ACTIVIN A, a GSK3b inhibitor, a ROCK inhibitor, a P38 inhibitor, a JNK inhibitor and a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, G9a and/or G1p inhibitor (e.g., BIX01294 or UNC0638), stem cell factor (SCF), YAP/TAZ inhibitor, L-Ascorbic Acid, LSD1 inhibitor, and DOT1L inhibitor.

According to some embodiments of the invention, the medium further comprises an at least one agent selected from the group consisting of: Activin A, transforming growth factor beta 1 (TGFβ1), a fibroblast growth factor receptor (FGFR) inhibitor, a GSK3b inhibitor, a ROCK inhibitor, a P38 inhibitor, a JNK inhibitor and a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, G9a and/or G1p inhibitor (e.g., BIX01294 or UNC0638), stem cell factor (SCF), YAP/TAZ inhibitor, L-Ascorbic Acid, LSD1 inhibitor, and DOT1L inhibitor.

According to some embodiments of the invention, the medium further comprises an at least one agent selected from the group consisting of: basic fibroblast growth factor (bFGF), a transforming growth factor receptor (TGFR) inhibitor, a GSK3b inhibitor, a ROCK inhibitor, a P38 inhibitor, a JNK inhibitor, a NOTCH inhibitor, a SRC inhibitor, insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, G9a and/or G1p inhibitor (e.g., BIX01294 or UNC0638), stem cell factor (SCF), YAP/TAZ inhibitor, L-Ascorbic Acid, LSD1 inhibitor, and DOT1L inhibitor.

According to some embodiments of the invention, the culture medium of some embodiments of the invention is any of the culture media described in Example 5 of the Examples section which follows (e.g., culture media 41-131).

Additionally or alternatively, FIGS. 1-2 and Examples 1-4 of the Examples section which follows, demonstrate additional conditions which can be used to maintain naive PSCs in the "naive state", as is evidenced by the expression of OCT4-GFP+ (positive) cells.

According to an aspect of some embodiments of the present invention there is provided a culture medium comprising an ERK1/2 inhibitor, a STAT3 activator and a SRC inhibitor.

According to some embodiments of the invention, the culture medium of some embodiments of the invention further comprises an AXIN complex stabilizer (AXINs).

According to some embodiments of the invention, the culture medium of some embodiments of the invention further comprises a GSK3β inhibitor.

According to some embodiments of the invention, the culture medium of some embodiments of the invention further comprises a p38 inhibitor.

According to an aspect of some embodiments of the present invention there is provided a culture medium comprising an ERK1/2 inhibitor, a GSK3β inhibitor, a p38 inhibitor, a STAT3 activator and at least one agent selected from the group consisting of a SRC inhibitor and an AXIN complex stabilizer (AXINs).

The media of this aspect of the present invention may comprise an Src family kinase inhibitor and not an AXIN complex stabilizer. Alternatively, the media of this aspect of the present invention may comprise an AXIN complex stabilizer and not an Src family kinase inhibitor. Still alternatively, the media of this aspect of the present invention may comprise an Src family kinase inhibitor and an AXIN complex stabilizer.

According to some embodiments of the invention, the culture medium of some embodiments of the invention is chemically defined and xeno free (devoid of animal contaminant, or devoid of non-human contaminants).

It should be noted that supplementation of the culture medium with SRCi and/or AXINs small molecule compounds allows expansion of human naive pluripotent cells in media that does not include animal components (ALBU-MAX1, ALBUMAX2, Knockout-serum replacement—Invitrogen), and can rely only on the use of defined supplements like B27 (defined or Xenofree B27 supplement from INVITROGEN).

According to some embodiments of the invention, the culture medium further comprising a ROCK inhibitor.

According to some embodiments of the invention, the culture medium further comprising a JNK inhibitor.

According to some embodiments of the invention, the culture medium comprises KO-DMEM with N2 supplement (e.g., about 5 ml N2 per 500 ml of culture medium) with about 5 ml defined lipid concentrate per 500 ml medium, LIF (about 20 ng/ml), bFGF (about 8 ng/ml), TGFβ1 (about 1 ng/ml), ERK1/2i (about 1 μM of PD0325901), GSK3bi (CHIR99021, about 3 μM), p38i (SB203580, about 5 μM), and JNKi (SP600125, about 5-10 μM).

According to some embodiments of the invention, the culture medium comprises KO-DMEM with N2 supplement (e.g., about 5 ml N2 per 500 ml of culture medium) with about 1-2% Albumax®II, LIF (about 20 ng/ml), bFGF (about 8 ng/ml), TGFβ1 (about 1 ng/ml), ERK1/2i (about 1 μM of PD0325901), GSK3bi (CHIR99021, about 3 μM), p38i (SB203580, about 5 μM), and JNKi (SP600125, 5-about 10 μM).

According to some embodiments of the invention, the culture medium comprises KO-DMEM with N2 supplement (e.g., about 5 ml N2 per 500 ml of culture medium) with about 15% Knockout SR (Gibco), LIF (about 20 ng/ml), bFGF (about 8 ng/ml), TGFβ1 (about 1 ng/ml), ERK1/2i (about 1 μM of PD0325901), GSK3bi (CHIR99021, about 3 μM), p38i (SB203580, about 5 μM), JNKi (SP600125, about 5-10 μM).

In one embodiment, the media which comprise an ERK1/2 inhibitor, a GSK3β inhibitor, a p38 inhibitor, a STAT3 activator and at least one agent selected from the group consisting of a SRC inhibitor and an AXIN complex stabilizer (AXINs) also comprises a ROCK inhibitor.

In another embodiment, the media which comprise an ERK1/2 inhibitor, a GSK3β inhibitor, a p38 inhibitor, a STAT3 activator, at least one agent selected from the group consisting of a SRC inhibitor and an AXIN complex stabilizer (AXINs) also comprises a ROCK inhibitor and optionally a ROCK inhibitor also comprise a JNK inhibitor.

The culture media described herein may comprise additional signaling optimizing components. Such optimizing components may include PI3K boosters, TGF cytokines (or inducers), morphogene inhibitors and FGF receptor inhibitors.

Examples of morphogene inhibitors include NOTCH inhibitors, SHH inhibitors and TGFβ receptor inhibitors.

Particular combinations of optimizing agents considered by the present invention include at least one of the following agents: bFGF, TGFβ1, TGFR inhibitor and a FGF receptor inhibitor.

According to a particular embodiment, the morphogene inhibitor is a TGFβ receptor inhibitor.

Other combinations of optimizing agents considered by the present invention include at least two of the following agents: bFGF, TGFβ1, TGFR inhibitor and a FGF receptor inhibitor.

In certain embodiments the media of the present invention may include a protein kinase C inhibitor and/or a BMP inhibitor.

In other embodiments the media of the present invention are devoid of a protein kinase C inhibitor and/or a BMP inhibitor.

According to some embodiments of the invention, the culture medium further comprising at least one additional agent selected from the group consisting of: insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, G9a and/or G1p inhibitor (e.g., BIX01294 or UNC0638), and stem cell factor (SCF).

According to some embodiments of the invention, the culture medium further comprising at least one additional agent selected from the group consisting of: insulin-like growth factor 1 (IGF1), insulin-like growth factor II (IGFII), bone morphogenetic protein 4 (BMP4), a Sonic Hedgehog pathway (SHH) inhibitor, an ERK5 inhibitor, Forskolin, Kenpaullone, BayK8644, G9a and/or G1p inhibitor (e.g., BIX01294 or UNC0638), and stem cell factor (SCF).

Exemplary media contemplated by the present invention include:

A medium comprising a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor.

A medium comprising a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor and a BMP inhibitor.

A medium comprising a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor and a PKC inhibitor.

A medium comprising a STAT3 activator, an ERK1/2 inhibitor, a GSK3β inhibitor, a P38 inhibitor, a JNK inhibitor, bFGF, TGFβ1, a ROCK inhibitor, AXIN stabilizer and SRC family kinase inhibitor, a BMP inhibitor and a PKC inhibitor.

A medium comprising a STAT3 activator, an ERK1/2 inhibitor, a GSK3β inhibitor, a P38 inhibitor, a bFGF, TGFβ1, a ROCK inhibitor, AXIN stabilizer and SRC family kinase inhibitor.

A medium comprising a STAT3 activator, an ERK1/2 inhibitor, a GSK3β inhibitor, a P38 inhibitor, a bFGF, TGFβ1, a ROCK inhibitor, AXIN stabilizer, SRC family kinase inhibitor and a BMP inhibitor.

A medium comprising a STAT3 activator, an ERK1/2 inhibitor, a GSK3β inhibitor, a P38 inhibitor, a bFGF, TGFβ1, a ROCK inhibitor, AXIN stabilizer, SRC family kinase inhibitor and a PKC inhibitor.

A medium comprising a STAT3 activator, an ERK1/2 inhibitor, a GSK3β inhibitor, a P38 inhibitor, a bFGF, TGFβ1, a ROCK inhibitor, AXIN stabilizer, SRC family kinase inhibitor, a BMP inhibitor and a PKC inhibitor.

A medium comprising a STAT3 activator, an ERK1/2 inhibitor, a GSK3β inhibitor, a P38 inhibitor, a JNK inhibitor, TGFβ1, a ROCK inhibitor, AXIN stabilizer and SRC family kinase inhibitor.

A medium comprising a STAT3 activator, an ERK1/2 inhibitor, a GSK3β inhibitor, a P38 inhibitor, a JNK inhibitor, TGFβ1, a ROCK inhibitor, AXIN stabilizer, a SRC family kinase inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, AXIN stabilizer, a SRC family kinase inhibitor and a PKC inhibitor.

A medium comprising a STAT3 activator, an ERK1/2 inhibitor, a RAF inhibitor, a GSK3β inhibitor, a P38 inhibitor, a JNK inhibitor, TGFβ1, a ROCK inhibitor, AXIN stabilizer, a SRC family kinase inhibitor and a PKC inhibitor.

A medium comprising a STAT3 activator, an ERK1/2 inhibitor, a RAF inhibitor, a GSK3β inhibitor, a P38 inhibitor, a JNK inhibitor, TGFβ1, a ROCK inhibitor, AXIN stabilizer, and a SRC family kinase inhibitor.

A medium comprising a STAT3 activator, an ERK1/2 inhibitor, a RAF inhibitor, a GSK3β inhibitor, a P38 inhibitor, a JNK inhibitor, TGFβ1, a ROCK inhibitor, AXIN stabilizer, a SRC family kinase inhibitor and a PKC inhibitor.

A medium comprising a STAT3 activator, an ERK1/2 inhibitor, a RAF inhibitor, a bFGF, a GSK3β inhibitor, a P38 inhibitor, a JNK inhibitor, TGFβ1, a ROCK inhibitor, AXIN stabilizer, and a SRC family kinase inhibitor.

A medium comprising a STAT3 activator, an ERK1/2 inhibitor, a GSK3β inhibitor, a P38 inhibitor, a JNK inhibitor, TGFβ1, a ROCK inhibitor, AXIN stabilizer, a SRC family kinase inhibitor, a PKC inhibitor and a BMP inhibitor.

A medium comprising a STAT3 activator, an ERK1/2 inhibitor, a GSK3β inhibitor, a P38 inhibitor, a JNK inhibitor, FGF2, TGFβ1, a ROCK inhibitor and a SRC family kinase inhibitor.

A medium comprising a STAT3 activator, an ERK1/2 inhibitor, a GSK3β inhibitor, a P38 inhibitor, a JNK inhibitor, FGF2, TGFβ1, a ROCK inhibitor, a SRC family kinase inhibitor and a BMP inhibitor.

A medium comprising a STAT3 activator, an ERK1/2 inhibitor, a GSK3β inhibitor, a P38 inhibitor, a JNK inhibitor, FGF2, TGFβ1, a ROCK inhibitor, a SRC family kinase inhibitor and a PKC inhibitor.

A medium comprising a STAT3 activator, an ERK1/2 inhibitor, a GSK3β inhibitor, a P38 inhibitor, a JNK inhibitor, FGF2, TGFβ1, a ROCK inhibitor, a SRC family kinase inhibitor, a PKC inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor and a SRC family kinase inhibitor.

A medium comprising a STAT3 activator, an ERK1/2 inhibitor, a GSK3β inhibitor, a P38 inhibitor, a JNK inhibitor, TGFβ1, a ROCK inhibitor, a SRC family kinase inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, a SRC family kinase inhibitor and a PKC inhibitor.

A medium comprising a STAT3 activator, an ERK1/2 inhibitor, a GSK3β inhibitor, a P38 inhibitor, a JNK inhibitor, TGFβ1, a ROCK inhibitor, a SRC family kinase inhibitor, a PKC inhibitor and a BMP inhibitor.

A medium comprising a STAT3 activator, an ERK1/2 inhibitor, a GSK3β inhibitor, a P38 inhibitor, a JNK inhibitor, a ROCK inhibitor, an AXIN stabilizer and a SRC family kinase inhibitor.

A medium comprising a STAT3 activator, an ERK1/2 inhibitor, a GSK3β inhibitor, a P38 inhibitor, a JNK inhibitor, a ROCK inhibitor, an AXIN stabilizer, a SRC family kinase inhibitor and a BMP inhibitor.

A medium comprising a STAT3 activator, an ERK1/2 inhibitor, a GSK3β inhibitor, a P38 inhibitor, a JNK inhibitor, a ROCK inhibitor, an AXIN stabilizer, a SRC family kinase inhibitor and a PKC inhibitor.

A medium comprising a STAT3 activator, an ERK1/2 inhibitor, a GSK3β inhibitor, a P38 inhibitor, a JNK inhibitor, a ROCK inhibitor, an AXIN stabilizer, a SRC family kinase inhibitor, a PKC inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor and an AXIN stabilizer.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer and a PKC inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, a PKC inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor and a FGF receptor inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor, a FGF receptor inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor, a FGF receptor inhibitor and a PKC inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, an SRC family kinase inhibitor, a FGF receptor inhibitor, a PKC inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer and a FGF receptor inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, a FGF receptor inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, a FGF receptor inhibitor and a PKC inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, a FGF receptor inhibitor, a PKC inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, Src family kinase inhibitor and a TGF receptor inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, Src family kinase inhibitor, a TGF receptor inhibitor and a BMP inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, Src family kinase inhibitor, a TGF receptor inhibitor and a PKC inhibitor.

A medium comprising a STAT3 activator, an ERK1/2 inhibitor, a GSK3β inhibitor, a P38 inhibitor, a JNK inhibitor, TGFβ1, a ROCK inhibitor, an AXIN stabilizer, Src family kinase inhibitor, a TGF receptor inhibitor, a PKC inhibitor and a BMP inhibitor.

Another contemplated culture medium is one which comprises an ERK1/2 inhibitor, a GSK3β inhibitor, a p38 inhibitor, a JNK inhibitor, a STAT3 activator, a transforming growth factor beta receptor (TGFβR) inhibitor, a PKC inhibitor, a p38 inhibitor and basic fibroblast growth factor (bFGF).

This medium may also comprise at least one, at least two, at least three or four of the agents selected from the group consisting of a BMP inhibitor, a ROCK inhibitor, a SRC inhibitor and an AXIN complex stabilizer (AXINs).

Non-limiting examples of culture medium which can be used according to some embodiments of the invention are described in Example 1 of the Examples section which follows (e.g., culture media 1-40).

It will be appreciated that any of the proteinaceous factors used in the culture medium of some embodiments of the invention (e.g., the LIF, IL6, TGFβ1, or bFGF) can be recombinantly expressed or biochemically synthesized. In addition, naturally occurring proteinaceous factors such as bFGF and TGFβ can be purified from biological samples (e.g., from human serum, cell cultures) using methods well known in the art.

Biochemical synthesis of the proteinaceous factors of the present invention (e.g., the LIF, IL6, TGFβ1, or bFGF) can be performed using standard solid phase techniques. These methods include exclusive solid phase synthesis, partial solid phase synthesis methods, fragment condensation and classical solution synthesis.

Recombinant expression of the proteinaceous factors of the present invention (e.g., the LIF, IL6, TGFβ1, or bFGF) can be generated using recombinant techniques such as described by Bitter et al., (1987) Methods in Enzymol. 153:516-544, Studier et al. (1990) Methods in Enzymol. 185:60-89, Brisson et al. (1984) Nature 310:511-514, Takamatsu et al. (1987) EMBO J. 6:307-311, Coruzzi et al. (1984) EMBO J. 3:1671-1680, Brogli et al., (1984) Science 224:838-843, Gurley et al. (1986) Mol. Cell. Biol. 6:559-565 and Weissbach & Weissbach, 1988, Methods for Plant Molecular Biology, Academic Press, NY, Section VIII, pp 421-463.

For example, to generate the LIF, IL6, TGFβ1, or bFGF, a polynucleotide sequence encoding the LIF, IL6, TGFβ1, or bFGF [e.g., the polynucleotide set forth by SEQ ID NO: 30 (LIF, GenBank Accession No. NM_001257135), SEQ ID NO: 31 (TGFβ1, GenBank Accession NO. NM_000660), SEQ ID NO: 32 (BFGF, GenBank Accession NO. NM_002006), SEQ ID NO:111 (IL6, GenBank Accession No. NM_000600.3)] is preferably ligated into a nucleic acid construct suitable for expression in a host cell [i.e., a cell in which the polynucleotide encoding the polypeptide-of-choice (e.g., the LIF, IL6, TGFβ1, or bFGF) is expressed]. Preferably, to generate an LIF, IL6, TGFβ1, or bFGF with the amount and pattern of glycosylation as of the naturally occurring LIF, IL6, TGFβ1, or bFGF, the host cell employed is a eukaryotic host cell, more preferably a mammalian host cell such as human cell or CHO cell). Additional description of nucleic acid constructs (or expression vectors) which can be used to produce a polypeptide-of-interest (e.g., the proteinaceous factors described above) is provided herein under.

According to some embodiments of the invention, the culture medium further comprises an MBD3 inhibitor.

As used herein the term "MBD3" refers to the Methyl-CpG-binding domain 3 protein set forth by GenBank Accession No. NP_003917.1 (SEQ ID NO:7) having the co-repressor and chromatin remodeling functional activity.

As used herein the term "MBD3 inhibitor" refers to any agent (e.g., a molecule) capable of downregulating the expression level and/or activity of MBD3, and/or capable of interfering between the interaction of MBD3 with OCT4, and/or MBD3 with SOX2, and/or MBD3 and KLF4 and/or MBD3 and C-Myc, and/or inhibiting the binding of MBD3 to the nucleosome remodeling and deacetylase (NuRD). Downregulation of MBD3 can be effected on the genomic and/or the transcript level using a variety of molecules which interfere with transcription and/or translation [e.g., RNA silencing agents (e.g., antisense, siRNA, shRNA, micro-RNA), Ribozyme and DNAzyme], or on the protein level using e.g., an antibody (e.g., a neutralizing antibody), an antagonist, e.g., small molecules which inhibit MBD3 activity or ability to directly interact with any of the reprogramming factors (Oct4, Sox2, Klf4or c-Myc), enzymes that cleave the polypeptide and the like.

Non-limiting examples of MBD3 inhibitors include siRNA directed against MBD3 mRNA, such as those provided from Invitrogen, mBD3HSS147581(3_RNAI) (Invitrogen): AGGUCAAGGGCAAGCCCGACCUGAA (SEQ ID NO:52); and MBD3HSS147581 (3_RNAI)(Invitrogen): UUCAGGUCGGGCUUGCCCUUGACCU (SEQ ID NO:53). Another suitable siRNA directed against MBD3 mRNA which can be used is the commercially available MBD3 Stealth siRNAs that include HSS147580 and HSS147581 components (Life Technologies™, catalogue number 1299001) that were found efficient for MBD3 knockdown in human cells.

According to some embodiments of the invention, inhibiting the binding of Mbd3 to the NuRD complex is performed using a chromodomain helicase DNA binding protein 4 (CHD4) inhibitor.

Non-limiting examples of CHD4 inhibitors include the human CHD4 siRNA, such as the CHD4 stealth siRNA HSS101850 available from Life Technologies™ which was found to efficiently knockdown CHD4 in human cells.

According to some embodiments of the invention, inhibiting the binding of Mbd3 to the NuRD complex is performed using a P66 alpha coiled-coil (P66α-CC) domain.

The peptide of the P66α-CC (SEQ ID NO: 114) can be added to the medium as is, or can be recombinantly expressed from a vector encoding the P66α-CC sequence (e.g., a vector which comprises the nucleotide sequence set forth in SEQ ID NO: 113).

According to some embodiments of the invention, inhibiting the binding of Mbd3 to the NuRD complex is performed using an inhibitor of the GATA zinc finger domain containing 2A (GATAD2A) protein [also known as "transcriptional repressor p66-alpha; e.g., isoform 1, GenBank Accession Nos. NP_001287875.1 (SEQ ID NO:150 for protein) and NM_001300946.1 (SEQ ID NO: 151 for polynucleotide), and isoform 2, GenBank Accession Nos. NP_060130.3 (SEQ ID NO:152 for protein) and NM_017660.3 (SEQ ID NO:153 for polynucleotide). Such inhibitor can be, for example, a small molecule, an siRNA directed against the polynucleotide encoding GATAD2A, or dominant negative peptide.

According to some embodiments of the invention, inhibiting Mbd3 expression is performed using a protein kinase C (PKC) inhibitor (e.g., using the agents and molecules as described above).

According to some embodiments of the invention, the medium further comprises an agent which increases expression of endogenous ERAS and/or a recombinant ERAS.

According to some embodiments of the invention, the MBD3 inhibitor is provided in an amount sufficient to downregulate the expression level of the MBD3 RNA and/or protein in the cell by at least about 30%, e.g., at least about 35%, e.g., at least about 40%, e.g., at least about 45%, e.g., at least about 50%, e.g., at least about 55%, e.g., at least about 60%, e.g., at least about 65%, e.g., at least about 70%, e.g., at least about 75%, e.g., at least about 80% as compared to the expression level of the MBD3 RNA and/or protein, respectively, in the same cell when incubated and/or cultured under the same (e.g., identical) conditions yet without the MBD3 inhibitor.

According to some embodiments of the invention, the MBD3 inhibitor is provided in an amount sufficient to downregulate the expression level of the MBD3 RNA and/or protein in the cell by about 30-90%, e.g., about 30-85%, e.g., about 40-85%, e.g., about 50-85%, e.g., about 60-85%, e.g., about 70-85%, e.g., about 80-85%, e.g., about 85% as compared to the expression level of the MBD3 RNA and/or protein, respectively, in the same cell when incubated and/or cultured under the same (e.g., identical) conditions yet without the MBD3 inhibitor.

The expression level of the MBD3 in the cell can be determined by various methods such as real time reverse transcription PCR, Western blot and the like. For example, when such an assay was employed, there was about 85% inhibition of MBD3 protein level in cells transformed with the MBD3$^{flox/-}$ construct (Data not shown).

Additional culture media contemplated by the present invention include those disclosed in PCT IB 2014/060954, the entire contents of which is incorporated herein by reference.

According to an aspect of some embodiments of the invention, there is provided a cell culture comprising cells and the culture medium of some embodiments of the invention.

The cells may be any cells, e.g., prokaryotic or eukaryotic cells, e.g., primate cells, e.g., mammalian cells, e.g., human cells.

According to some embodiments of the invention, the cells are somatic cells, stem cells, primed pluripotent stem cells, non-naïve pluripotent stem cell and/or naïve pluripotent stem cells.

According to some embodiments of the invention, the culture medium is capable of maintaining naive pluripotent stem cell in an undifferentiated state for at least 2 passages, e.g., for at least 5, 10, 20, 30, 40, 50, 60, 70, 80, 90 or 100 passages.

According to some embodiments of the invention, the primate naive pluripotent stem cell is of *Homo sapiens* (human), monkey, chimpanzee, Gorillas, Rhesus and/or Baboon.

The phrase "naive pluripotent stem cell (PSC)" refers to a cell capable of forming a PSC, and that exhibits a pre-X-inactivation state, and therefore is considered to be the origin of the PSC.

It should be noted that the naive PSCs of some embodiments of the invention (which are in a pre-X inactivation and a naive state) can upon differentiation inactivate one of the X chromosome alleles and methylate one of the alleles of the promoter of the XIST gene.

The pre-X-inactivation state according to some embodiments of the invention is characterized by presence of two unmethylated alleles of the promoter of the X-inactive specific transcript (XIST) gene in the female cell, and presence an unmethylated allele of the promoter of the XIST gene in a male cell.

The XIST gene is located on human Xq13.2 chromosome and has the sequence depicted in clone NC_000023.10 (73040486.73072588, complement, based on GenBank version GRCh37.p10. The XIST gene has a non-coding RNA which is provided in GenBank Accession NO. NR_001564.2 (SEQ ID NO:20).

According to some embodiments of the invention, presence of two unmethylated alleles of the promoter of the XIST gene in a female cell refers to having below about 20% of CpG methylated reads sequenced in the XIST promoter (i.e., less than 20% of CpG sites in the XIST promoter amplicon set forth by SEQ ID NO:70 being methylated), e.g., below about 19%, below about 18%, below about 17%, below about 16%, below about 15%, below about 14%, below about 13%, below about 12%, below about 11%, below about 10%, below about 9%, below about 8%, below about 7%, below about 6%, below about 5%, below about 4%, below about 3%, below about 2%, below about 1%, e.g., 0% (e.g., complete absence) of CpG methylated reads sequenced in the XIST promoter.

According to some embodiments of the invention, presence of one unmethylated allele of the promoter of the XIST gene in a male cell refers to having below about 20% of CpG methylated reads sequenced in the XIST promoter (i.e., less than 20% of CpG sites in the XIST promoter amplicon set forth by SEQ ID NO:70 being methylated), e.g., below about 19%, below about 18%, below about 17%, below about 16%, below about 15%, below about 14%, below about 13%, below about 12%, below about 11%, below about 10%, below about 9%, below about 8%, below about 7%, below about 6%, below about 5%, below about 4%, below about 3%, below about 2%, below about 1%, e.g., 0% of CpG methylated reads sequenced in the XIST promoter.

A non-limited example of the XIST promoter which includes CpG islands which can be either methylated or unmethylated is provided in the XIST promoter amplicon set forth by SEQ ID NO:70.

According to some embodiments of the invention, the unmethylated alleles of the promoter of the XIST gene in a female cell comprise less than 20% of CpG sites in the XIST promoter amplicon set forth by SEQ ID NO:70 being methylated. Non-limiting examples of such unmethylated alleles of the XIST gene in a female naïve pluripotent stem cell are shown in FIGS. 17A-E.

According to some embodiments of the invention, the unmethylated allele of the promoter of the XIST gene in a male cell comprises less than 20% of CpG sites in the XIST promoter amplicon set forth by SEQ ID NO:70 being methylated. Non-limiting examples of an unmethylated allele of the XIST gene in a male naïve pluripotent stem cell are shown in FIGS. 17A-E.

According to some embodiments of the invention, the human naive PSC is characterized by a reduced methylation of CpG islands in the promoter of the XIST gene as compared to a level of methylation of the CpG islands in a human primed PSC.

Human naive ESCs are characterized by significantly low levels of total methylated cytosine out of the total guanine nucleotides in each cell (e.g., 1-2%) as determined by Liquid Chromatography-Mass Spectrometry (LC-MS) quantitative analysis.

According to some embodiments of the invention, the human naive PSC is characterized by 0-3% of total methylated cytosine out of the total Guanine nucleotides in the naive PSC cell. For comparison, the primed PSC or a somatic cell has between 3.5%-5% of total methylated cytosine out of the total Guanine nucleotides in the primed PSC cell.

Thus, the naive pluripotent stem cell of some embodiments of the invention is in the "naive state" as explained above.

Thus, the culture medium of some embodiments of the invention is capable of maintaining naïve PSC in a naïve state. As used herein the term "isolated" refers to at least partially separated from the natural environment e.g., from the primate (e.g., mammalian) embryo or the primate (e.g., mammalian) body.

According to some embodiments of the invention, the non-naive PSC is selected from the group consisting of a primed PSC, an embryonic stem cell, a blastocyst, an induced pluripotent stem cell (a primed iPSC) and a somatic cell.

According to some embodiments of the invention, the non-naive PSC is not an embryonic stem cell.

The phrase "embryonic stem cells" refers to embryonic cells which are capable of differentiating into cells of all three embryonic germ layers (i.e., endoderm, ectoderm and mesoderm), or remaining in an undifferentiated state. The phrase "embryonic stem cells" may comprise cells which are obtained from the embryonic tissue formed after gestation (e.g., blastocyst) before implantation of the embryo (i.e., a pre-implantation blastocyst), extended blastocyst cells (EBCs) which are obtained from a post-implantation/pre-gastrulation stage blastocyst (see WO2006/040763) and embryonic germ (EG) cells which are obtained from the genital tissue of a fetus any time during gestation, preferably before 10 weeks of gestation.

Induced pluripotent stem cells (iPS; embryonic-like stem cells), are cells obtained by de-differentiation of adult somatic cells which are endowed with pluripotency (i.e., being capable of differentiating into the three embryonic germ cell layers, i.e., endoderm, ectoderm and mesoderm). According to some embodiments of the invention, such cells are obtained from a differentiated tissue (e.g., a somatic tissue such as skin) and undergo de-differentiation by genetic manipulation which re-program the cell to acquire embryonic stem cells characteristics. According to some embodiments of the invention, the induced pluripotent stem cells are formed by inducing the expression of Oct-4, Sox2, Kfl4 and c-Myc in a somatic stem cell.

The embryonic stem cells of some embodiments of the invention can be obtained using well-known cell-culture methods. For example, human embryonic stem cells can be isolated from human blastocysts. Human blastocysts are typically obtained from human in vivo preimplantation embryos or from in vitro fertilized (IVF) embryos. Alternatively, a single cell human embryo can be expanded to the blastocyst stage. For the isolation of human ES cells the zona pellucida is removed from the blastocyst and the inner cell mass (ICM) is isolated by immunosurgery, in which the trophectoderm cells are lysed and removed from the intact ICM by gentle pipetting.

The ICM is then plated in a tissue culture flask containing the appropriate medium which enables its outgrowth. Following 9 to 15 days, the ICM derived outgrowth is dissociated into clumps either by a mechanical dissociation or by an enzymatic degradation and the cells are then re-plated on a fresh tissue culture medium. Colonies demonstrating undifferentiated morphology are individually selected by micropipette, mechanically dissociated into clumps, and re-plated. Resulting ES cells are then routinely split every 4-7 days. For further details on methods of preparation human ES cells see Thomson et al., [U.S. Pat. No. 5,843, 780; Science 282: 1145, 1998; Curr. Top. Dev. Biol. 38: 133, 1998; Proc. Natl. Acad. Sci. USA 92: 7844, 1995]; Bongso et al., [Hum Reprod 4: 706, 1989]; and Gardner et al., [Fertil. Steril. 69: 84, 1998].

Another method for preparing ES cells is described in Chung et al., Cell Stem Cell, Volume 2, Issue 2, 113-117, 7 Feb. 2008. This method comprises removing a single cell from an embryo during an in vitro fertilization process. The embryo is not destroyed in this process.

It will be appreciated that commercially available stem cells can also be used according to some embodiments of the invention. Human ES cells can be purchased from the NIH human embryonic stem cells registry [Hypertext Transfer Protocol://grants(dot)nih(dot)gov/stem_cells/registry/current(dot)htm]. Non-limiting examples of commercially available embryonic stem cell lines are BG01, BG02, BG03, BG04, CY12, CY30, CY92, CY10, TE03, TE32, CHB-4, CHB-5, CHB-6, CHB-8, CHB-9, CHB-10, CHB-11, CHB-12, HUES 1, HUES 2, HUES 3, HUES 4, HUES 5, HUES 6, HUES 7, HUES 8, HUES 9, HUES 10, HUES 11, HUES 12, HUES 13, HUES 14, HUES 15, HUES 16, HUES 17, HUES 18, HUES 19, HUES 20, HUES 21, HUES 22, HUES 23, HUES 24, HUES 25, HUES 26, HUES 27, HUES 28, CyT49, RUES3, WA01, UCSF4, NYUES1, NYUES2, NYUES3, NYUES4, NYUES5, NYUES6, NYUES7, UCLA 1, UCLA 2, UCLA 3, WA077 (H7), WA09 (H9), WA13 (H13), WA14 (H14), HUES 62, HUES 63, HUES 64, CT1, CT2, CT3, CT4, MA135, Eneavour-2, WIBR1, WIBR2, WIBR3, WIBR4, WIBR5, WIBR6, HUES 45, Shef 3, Shef 6, BJNhem19, BJNhem20, SA001, SA001.

In addition, ES cells can be obtained from other species as well, including mouse (Mills and Bradley, 2001), golden hamster [Doetschman et al., 1988, Dev Biol. 127: 224-7], rat [Iannaccone et al., 1994, Dev Biol. 163: 288-92] rabbit [Giles et al. 1993, Mol Reprod Dev. 36: 130-8; Graves & Moreadith, 1993, Mol Reprod Dev. 1993, 36: 424-33], several domestic animal species [Notarianni et al., 1991, J Reprod Fertil Suppl. 43: 255-60; Wheeler 1994, Reprod Fertil Dev. 6: 563-8; Mitalipova et al., 2001, Cloning. 3: 59-67] and non-human primate species (Rhesus monkey and marmoset) [Thomson et al., 1995, Proc Natl Acad Sci USA. 92: 7844-8; Thomson et al., 1996, Biol Reprod. 55: 254-9].

Extended blastocyst cells (EBCs) can be obtained from a blastocyst of at least nine days post fertilization at a stage prior to gastrulation. Prior to culturing the blastocyst, the zona pellucida is digested [for example by Tyrode's acidic solution (Sigma Aldrich, St Louis, MO, USA)] so as to expose the inner cell mass. The blastocysts are then cultured as whole embryos for at least nine and no more than fourteen days post fertilization (i.e., prior to the gastrulation event) in vitro using standard embryonic stem cell culturing methods.

EG cells are prepared from the primordial germ cells obtained from fetuses of about 8-11 weeks of gestation (in the case of a human fetus) using laboratory techniques known to anyone skilled in the arts. The genital ridges are dissociated and cut into small chunks which are thereafter disaggregated into cells by mechanical dissociation. The EG cells are then grown in tissue culture flasks with the appropriate medium. The cells are cultured with daily replacement of medium until a cell morphology consistent with EG cells is observed, typically after 7-30 days or 1-4 passages. For additional details on methods of preparation human EG cells see Shamblott et al., [Proc. Natl. Acad. Sci. USA 95: 13726, 1998] and U.S. Pat. No. 6,090,622.

Induced pluripotent stem cells (iPS) (embryonic-like stem cells) can be generated from somatic cells by genetic manipulation of somatic cells, e.g., by retroviral transduction of somatic cells such as fibroblasts, hepatocytes, gastric epithelial cells with transcription factors such as Oct-3/4, Sox2, c-Myc, and KLF4 [Yamanaka S, Cell Stem Cell. 2007, 1(1):39-49; Aoi T, et al., Generation of Pluripotent Stem Cells from Adult Mouse Liver and Stomach Cells. Science. 2008 Feb. 14. (Epub ahead of print); I H Park, Zhao R, West J A, et al. Reprogramming of human somatic cells to pluripotency with defined factors. Nature 2008; 451:141-146; K Takahashi, Tanabe K, Ohnuki M, et al. Induction of pluripotent stem cells from adult human fibroblasts by defined factors. Cell 2007; 131:861-872]. Other embryonic-like stem cells can be generated by nuclear transfer to oocytes, fusion with embryonic stem cells or nuclear transfer into zygotes if the recipient cells are arrested in mitosis.

Culturing the cells in the media described herein may be effected in any vesicle, e.g. plate, chamber, bioreactor etc.

The number of cells that may be selected and/or cultured according to the method of the present invention may be any number including small batches—e.g. $100 \times 10^4$ cells to larger batches—e.g. $100 \times 10^6$ or $100 \times 10^7$ cells.

The cells may be cultured in a bioreactor (or in multi-level industrial flasks), the size of which is selected according to the number of cells being cultured.

As used herein, the term "bioreactor" refers to any device in which biological and/or biochemical processes develop under monitored and controlled environmental and operating conditions, for example, pH, temperature, pressure, nutrient supply and waste removal. According to one embodiment of the invention, the basic classes of bioreactors suitable for use with the present invention include static bioreactors, stirred flask bioreactors, rotating wall bioreactors, hollow fiber bioreactors and direct perfusion bioreactors.

According to a particular embodiment, the cells are cultured (i.e. expanded) on an adherent surface.

Examples of such surfaces are provided herein under.

1. Laminin/Fibronectin coated plates. Sources for Fibronectin: Sigma Aldrich Bovine Fibronectin F1141, or human Fibronectin Millipore FC010. Sources for Laminin: Sigma Aldrich Ewing Sarcoma derived Laminin L2020, Human Biolaminin 511 or Human Biolaminin 521 (Biolamina INC). For example, such a surface can be prepared by mixing laminin and fibronectin at a final concentration of 2 µg/ml, and coating wells of plates for at least 2 hours at 37° C., to obtain Laminin/Fibronectin-coated plates.
2. Cells can be expanded on gelatin and vitronectin coated plates (e.g. 0.2% gelatin and 1 µg/ml Vitronectin coated plates). For example, such a surface can be prepared by mixing gelatin solution with vitronectin, and using the mix to coat wells, for at least 1 hour at 37° C. It should be noted that coated plates can be left for up to 4 days in 37° C. and can still be used for cells.
3. Cells can be expanded on plates coated with 0.2% gelatin/irradiated mouse or human fibroblast feeder cells.
4. Human naïve cells can be expanded on plates coated with only 0.2% gelatin coated plates.
5. Human naïve cells can be expanded on plates coated with only Matrigel or geltrex (BD Biosciences). For example, such a surface can be prepared by incubating the plates with the Matrigel® (Corning Life Sciences) solution for 1 hour at 37° C.

The culture media described in the present application may be used for a myriad of purposes.

According to a particular embodiment, the culture media are used for expanding (i.e., increasing the number of) cells, e.g., expanding naïve PSCs.

It should be noted that culturing the naïve PSC involves replacing the culture medium with a "fresh" medium (of identical composition) every 24-48 hours, and passaging each culture dish (e.g., a plate) to 2 or 3 culture dishes (e.g., plates) every 3-5 days. Thus, when cells in the culture reach about 60-90% confluence the supernatant is discarded, the culture dishes are washed [e.g., with phosphate buffered saline (PBS)] and the cells are subjected to enzymatic dissociation from the culture dish, e.g., using trypsinization (0.25% or 0.05% Trypsin+EDTA), e.g., until single cells or cell clumps are separated from each other.

It should be noted that the culture conditions uncovered by the present inventors enables maintenance of human PSCs such as human iPSCs in the naive PSC state without the need of further exogenous expression of the Oct4, Sox2, Klf4 and/or c-Myc factors. This is in sharp contrast to all prior attempts to generate naive human PSCs which required exogenous expression of the Oct4, Sox2, Klf4 and/or c-Myc factors, and which upon withdrawal of these factors the naive PSCs spontaneously differentiated, and could not be maintained in the undifferentiated and pluripotent stem cells (See e.g., Hanna J, 2010b).

Thus, according to another aspect, the culture media described herein are used to generate naïve pluripotent stem cells.

More specifically, according to another aspect of the present invention there is provided a method of generating a naive pluripotent stem cell (PSC), comprising:

incubating a non-naïve PSC cell in any of the culture medium described herein, the culture medium allowing generation of the naïve PSC from the non-naïve PSC, wherein:
  (i) when the naïve PSC is a female PSC, then the naïve female PSC has two unmethylated alleles of the promoter of the X-inactive specific transcript (XIST) gene; and
  (ii) when the naïve PSC is a male PSC, then the naïve male PSC has an unmethylated allele of the promoter of the XIST gene; and/or
an expression level of transcription factor E3 (TFE3) in the naïve PSC is characterized by a nucleus to cytoplasm expression ratio which is equal to or higher than 1 as determined by an immunostaining assay; and/or
the naïve PSC is characterized by a positive expression of C-KIT (CD117) on the cell surface of the naïve PSC, thereby generating the naïve PSC.

Thus, the naïve PSC of the invention is characterized by a naïve state. This is demonstrated, for example, in FIGS. 17A-E and FIGS. 22A-B, which show that all of the tested culture media were capable of retaining a unique pre-X inactivation state which characterizes the naïve PSC. Thus, FIGS. 17A-E show examples of such unmethylated alleles as determining in the XIST promoter (in the amplicon set forth in SEQ ID NO:70). These results conclusively demonstrate that male and female Naive hESCs/iPSCs which are cultured on all of the tested culture media retain a unique pre-X inactivation state under various WIS-NHSM conditions.

In contrast, FIGS. 17F and 22C show examples of non-naïve PSC in which the promoter of the XIST gene in the male cells is completely methylated (i.e., most of the CpG sites in the XIST promoter are methylated), and one allele of the promoter of the XIST gene is methylated in the female cells.

As described above, the naïve PSC of some embodiments of the invention is characterized by a unique expression level of transcription factor E3 (TFE3). Thus, the expression level of TFE3 in the naïve PSC is characterized by a nucleus to cytoplasm expression ratio which is equal to or higher than 1 as determined by an immunostaining assay.

Table 1 in Example 5 of the Examples section which follows shows that all of the tested culture media were capable of maintaining the naïve PSCs in a naïve state which is characterized by a ratio higher than 1 between the nuclear and cytoplasmic TFE3 enrichment.

As described above, and shown in FIGS. 25A-C, the naïve PSC of some embodiments of the invention is characterized by a positive expression on the cell surface of the PSC of the C-KIT protein (also known as CD117). It should be noted that primed PSC do not express C-KIT at all, let alone on the cell surface of the cells. The results shown in FIGS. 25A-C support the conclusion that C-KIT is a novel marker for human naïve, but not primed, PSCs.

C-KIT, the human homolog of the proto-oncogene c-kit, was first identified as the cellular homolog of the feline sarcoma viral oncogene v-kit. This protein is a type 3 transmembrane receptor for MGF (mast cell growth factor, also known as "stem cell factor"). The sequence of the C-KIT protein is provided in GenBank Accession No. NP_000213.1 (SEQ ID NO:202 for isoform 1 precursor) and NP_001087241.1 (SEQ ID NO:203 for isoform 2 precursor).

The expression of C-KIT on the naïve PSC cells can be determined by any immunostaining assay, such as using flow-cytometry (e.g., FACS analysis) and/or by immuno fluorescence techniques, e.g., using a fluorescent microscope, and/or by a radioactively labeled antibody.

Exemplary culture medium for generating naïve pluripotent stem cells from non-naïve pluripotent stem cells include:
1. A culture medium which comprises KO-DMEM, N2 supplement, B27 supplement, LIF, ERK1/2 inhibitor, GSK3b inhibitor, p38 inhibitor, and an SRC inhibitor;
2. A culture medium which comprises DMEM-F12/NEURObasal (GIBCO) 1:1 mix, N2 supplement, B27 supplement, LIF, ERK1/2 inhibitor, GSK3b inhibitor, p38 inhibitor and an SRC inhibitor; or
3. A culture medium which comprises DMEM-F12, N2 supplement, B27 supplement, LIF, ERK1/2 inhibitor, GSK3b inhibitor, p38 inhibitor, and an SRC inhibitor.
4. A culture medium which comprises KO-DMEM, N2 supplement (Gibco), B27 supplement, LIF, ERK1/2 inhibitor, PKC inhibitor, and Axin stabilizer.
5. A culture medium which comprises DMEM-F12/NEURObasal (GIBCO) 1:1 mix, N2 supplement (Gibco), B27 supplement (GIBCO), LIF (STAT3 activator), ERK1/2 inhibitor, PKC inhibitor, and Axin stabilizer.
6. A culture medium which comprises DMEM-F12, N2 supplement (Gibco), B27 supplement, LIF (STAT3 activator), ERK1/2 inhibitor, PKC inhibitor, and Axin stabilizer.
7. A culture medium which comprises KO-DMEM, N2 supplement (Gibco), B27 supplement, LIF, ERK1/2 inhibitor, GSK3b inhibitor, PKC inhibitor, and Axin stabilizer.
8. A culture medium which comprises DMEM-F12/NEURObasal (GIBCO) 1:1 mix, N2 supplement (Gibco), B27 supplement (GIBCO), LIF (STAT3 activator), ERK1/2 inhibitor, GSK3b inhibitor, PKC inhibitor, and Axin stabilizer.
9. A culture medium which comprises DMEM-F12, N2 supplement (Gibco), B27 supplement, LIF (STAT3 activator), ERK1/2 inhibitor, GSK3b inhibitor, PKC inhibitor, and Axin stabilizer.
10. A culture medium comprising a STAT3 activator, an ERK1/2 inhibitor and an Axin stabilizer.
11. A culture medium comprising a STAT3 activator, an ERK1/2 inhibitor, an Axin stabilizer and a PKC inhibitor.
12. A culture medium comprising a STAT3 activator, an ERK1/2 inhibitor, an Axin stabilizer, a PKC inhibitor and a GSK3b inhibitor.
13. A culture medium comprising an ERK1/2 inhibitor, a STAT3 activator and a SRC inhibitor.
14. A culture medium comprising an ERK1/2 inhibitor, a STAT3 activator, a SRC inhibitor and an AXIN complex stabilizer (AXINs).
15. A culture medium comprising an ERK1/2 inhibitor, a STAT3 activator, a SRC inhibitor, an AXIN complex stabilizer (AXINs) and a GSK3β inhibitor.
16. A culture medium comprising an ERK1/2 inhibitor, a STAT3 activator, a SRC inhibitor, an AXIN complex stabilizer (AXINs), a GSK3β inhibitor and a p38 inhibitor.
17. A culture medium comprising an ERK1/2 inhibitor, a GSK3β inhibitor, a p38 inhibitor, a STAT3 activator and at least one agent selected from the group consisting of a SRC inhibitor and an AXIN complex stabilizer (AXINs).
18. A culture medium comprising an ERK1/2 inhibitor, a GSK3β inhibitor, a p38 inhibitor, a JNK inhibitor, a STAT3 activator, a transforming growth factor beta receptor (TGFβR) inhibitor, a PKC inhibitor, a p38 inhibitor and basic fibroblast growth factor (bFGF).
19. Any of the culture media described in Example 1 (culture media 1-40), Example 5 (culture media 41-131) and in Example 6 (culture media 132-147) in the Examples section which follows.

According to some embodiments of the invention, incubating the non-naive PSC cell in the culture medium is performed under culture conditions devoid of feeder cells, i.e., under feeder layer free conditions (e.g., on a Matrigel, Laminin, and/or fibronectin-coated surface).

According to some embodiments of the invention, incubating the non-naive PSC cell in the culture medium is performed under culture conditions which comprise culturing on feeder cells, such as fibroblasts [e.g., mouse embryonic fibroblasts (MEFs)], which support the growth of the pluripotent stem cells.

According to some embodiments of the invention, wherein when the non-naive PSC is derived from a somatic cell then the method further comprising subjecting the somatic cell to de-differentiation conditions, to thereby obtain an induced pluripotent stem cell.

According to some embodiments of the invention, de-differentiation conditions comprise exogenously expressing within the somatic cell at least two, e.g., at least three, at least four or more growth factors selected from the group consisting of OCT4 [GenBank Accession Nos. NP_002692.2 (SEQ ID NO:54) and NM_002701.4 (SEQ ID NO:55)], SOX2 [GenBank Accession Nos. NP_003097.1 (SEQ ID NO:56) and NM_003106.3 (SEQ ID NO:57)], KLF4 [GenBank Accession Nos. NP_004226.3 (SEQ ID NO:58) and NM_004235.4 (SEQ ID NO:59)], c-Myc [GenBank Accession Nos. NP_002458.2 (SEQ ID NO:60), and NM_002467.4 (SEQ ID NO:61)], ESRRB Estrogen-Related Receptor Beta GenBank Accession Nos. NM_004452.3 (SEQ ID NO: 124) and NP_004443.3 (SEQ ID NO: 125), Kruppel like factor 2, KLF2, [GenBank Accession Nos.: NP_057354.1 (SEQ ID NO:126) and NM_016270.2 (SEQ ID NO:127)] TBX3 [GenBank Accession Nos.: NP_005987.3 NP_057653.3 (SEQ ID NO:128 and 129)_ NM_005996.3 NM_016569.3 (SEQ ID NO:130 and SEQ ID NO: 131)], ERAS [GenBank Accession Nos.: NP_853510.1 (SEQ ID NO:132) and NM_181532.3 (SEQ ID NO:133) and Kruppel-like factor 17, KLF17 [GenBank Accession Nos.: NP_775755.3 (SEQ ID NO:154) and NM_173484.3 (SEQ ID NO:155, transcript encoding KLF17 protein)].

As used herein the phrase "exogenously expressing" refers to expressing a heterologous nucleic acid sequence which may not be naturally expressed within the cell or which overexpression in the cell is desired. The exogenous polynucleotide may be introduced into the cell in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the cell.

According to still another aspect of the present invention there is provided a method of improving generation of induced pluripotent stem cells (iPSCs) from a somatic cell, comprising:
(a) expressing within the somatic cell a first factor selected from the group consisting of Nanog, ESRRB, KLF2, TBX3, ERAS and KLF17, and a second factor selected from the group consisting of Nanog, ESRRB, KLF2, TBX3, ERAS, Oct4, Sox2, Klf4, c-Myc, and KLF17, wherein the first and second growth factor are non-identical; and
(b) inhibiting Mbd3 and/or Gatad2a expression and/or activity in the somatic cell, thereby improving generation of the iPSCs from a somatic cell.

According to some embodiments of the invention, expressing the factors is performed using DNA transfection of the factors.

Methods of DNA transfections into mammalian cells are known in the art and include those described in Reference (Mansour et al. 2012), which is fully incorporated herein by reference in its entirety. Further description of preparation of expression vectors and modes of administering them into cells are provided herein under.

According to some embodiments of the invention, expressing the factors is performed using RNA transfection of the growth factors.

Methods of RNA transfections into mammalian cells are known in the art and include those described for example in (Warren et al. 2010) which is fully incorporated herein by reference in its entirety.

Once obtained, the cells are cultured in a medium (e.g. those disclosed herein above) and are serially passaged.

According to some embodiments of the invention, exogenous expression of the factors is effected for a limited time, such as for no more than 10 days in culture, e.g., for no more than 1 passage.

According to some embodiments of the invention, once the naive iPSCs are generated from the somatic cells, they are further being cultured in the culture medium of some embodiments of the invention (e.g., the WIS-NHSM medium) without exogenous expression of the Nanog, ESRRB, KLF2, TBX3, ERAS Oct4, Sox2, Klf4c-Myc factors by the naive iPSCs, and without addition of the isolated Nanog, ESRRB, KLF2, TBX3, ERAS Oct4, Sox2, Klf4c-Myc factors to the culture medium.

As used herein the phrase "isolated . . . factors" refers to factors that are recombinantly expressed from an expression vector in a host cell (e.g., a bacteria), being biochemically synthesized, or being isolated from a biological sample (e.g., serum or cells).

The method of some embodiments of the invention can be used to improve generation of iPSCs from somatic cells as compared to generation of iPSC from somatic cells using expression of the Nanog, ESRRB, KLF2, TBX3, ERAS Oct4, Sox2, Klf4c-Myc factors in somatic cells without further inhibition of the Mbd3 expression (e.g. using the media disclosed herein above).

For example, when human somatic cells are used, the method may be effected using a medium which comprises leukemia inhibitor factor (LIF), an ERK1/2 inhibitor, a GSK3b inhibitor, a p38 inhibitor, a JNK inhibitor, basic fibroblast growth factor (bFGF), transforming growth factor-beta 1 (TGFβ1), and an MBD3 inhibitor, and optionally also a ROCK inhibitor. When the somatic cells are subject to de-differentiation using DNA transfection of the growth factors (e.g., at least two of the Oct4, Sox2, Klf4 and c-Myc), then the method results in at least about 30%, e.g., at least about 40%, at least about 50%, e.g., at least about 60%, at least about 70%, e.g., at least about 80%, at least about 90%, e.g., at least about 95%, at least about 99%, e.g., 100% more iPSCs as compared to the yield of the iPSCs obtained when the Oct4, Sox2, Klf4 and c-Myc are expressed using DNA transfection in the somatic cell without further inhibition of the Mbd3 expression.

For example, when human somatic cells are used, the method may be effected using a medium which comprises leukemia inhibitor factor (LIF), an ERK1/2 inhibitor, a GSK3b inhibitor, a p38 inhibitor, a JNK inhibitor, basic fibroblast growth factor (bFGF), transforming growth factor-beta 1 (TGFβ1), and an MBD3 inhibitor, and optionally also a ROCK inhibitor. When the somatic cells are subject to de-differentiation using RNA transfection of the growth factors (e.g., at least two of the Oct4, Sox2, Klf4 and c-Myc), then the method results in at least about 5%, e.g., at least about 10%, at least about 20%, e.g., at least about 30%, at least about 40%, e.g., at least about 50%, at least about 60%, e.g., at least about 75%, at least about 99%, e.g., 100% more iPSCs as compared to the yield of the iPSCs obtained when the Oct4, Sox2, Klf4 and c-Myc are expressed using RNA transfection in the somatic cell without further inhibition of the Mbd3 expression. Moreover, while the prior art methods (without MBD3 inhibition and without the medium of some embodiments of the present invention) employ 10-20 rounds of RNA transfection in order to achieve de-differentiation of human somatic cells, the method of some embodiments of the invention employs 1-4 rounds of RNA transfection in order to achieve de-differentiation of human somatic cells, and thus is far more efficient and time consuming.

The present inventors have uncovered that overexpression of ERAS or activation of endogenous human ERAS in pluripotent stem cells can be used to induce a naive state in pluripotent stem cells.

According to some embodiments of the invention, the method further comprising exogenously expressing ES cell expressed Ras (ERAS) coding sequence (e.g., SEQ ID NO: 109) or activating endogenous expression of the ERAS in the somatic cell.

According to some embodiments of the invention, activating endogenous expression of ERAS is performed by removing the premature poly adenylation sites of the endogenous ERAS gene (SEQ ID NO: 108), e.g., in A-1, A2 or A-3 boxed sequences in FIG. 3 by Kameda et al. Stem Cells 2005; 23:1535-1540; which is fully incorporated herein by reference in its entirety.

According to some embodiments of the invention, expressing is effected for at least 48 hours such that the inhibiting the Mbd3 is effected to 10-30% of a level of the Mbd3 prior to the expressing.

According to some embodiments of the invention, expressing is effected for about 48 hours and the inhibiting is effected after the about 48 hours.

It should be noted that when inhibition of Mbd3 is performed after 48 hours, the inhibition can be of 100% of the expression level of activity of MBD3.

According to some embodiments of the invention, the iPSC is a murine iPSC.

According to an aspect of some embodiments of the invention there is provided a method of generating differentiated cells, comprising subjecting the naive pluripotent stem cells generated according to the method of some embodiments of the invention or the iPSCs generated according to the methods of some embodiments of the invention to differentiating conditions, thereby generating the differentiated cells.

According to some embodiments of the invention, the naive PSCs or the iPSCs of some embodiments of the invention can be used to generate lineage specific cells.

As used herein, the phrase "generating lineage specific cells" refers to the enrichment of a mixed population of cells in a culture with cells predominantly displaying at least one characteristic associated with a specific lineage phenotype. It will be appreciated that all cell lineages are derived from the three embryonic germ layers. Thus, for example, hepatocytes and pancreatic cells are derived from the embryonic endoderm, osseous, cartilaginous, elastic, fibrous connective tissues, yachts, myocardial cells, bone marrow cells, vascular cells (namely endothelial and smooth muscle cells), and hematopoietic cells are differentiated from embryonic mesoderm and neural, retina and epidermal cells are derived from the embryonic ectoderm.

Lineage specific cells can be obtained by directly inducing the expanded, undifferentiated naive PSCs to culturing conditions suitable for the differentiation of specific cell lineage.

Following is a non-limiting description of a number of procedures and approaches for inducing differentiation of EBs to lineage specific cells. It will be appreciated that the present invention contemplates additional protocols for the ex vivo differentiation of the cells described herein, which do not work through the generation of EBs.

Neural Precursor Cells

To differentiate the EBs of some embodiments of the invention into neural precursors, four-day-old EBs are cultured for 5-12 days in tissue culture dishes including DMEM/F-12 medium with 5 mg/ml insulin, 50 mg/ml transferrin, 30 nM selenium chloride, and 5 mg/ml fibronectin (Its medium, Okabe, S. et al., 1996, Mech. Dev. 59: 89-102). The resultant neural precursors can be further transplanted to generate neural cells in vivo (Bristle, O. et al., 1997. In vitro-generated neural precursors participate in mammalian brain development. Proc. Natl. Acad. Sci. USA. 94: 14809-14814). It will be appreciated that prior to their transplantation, the neural precursors are trypsinized and triturated to single-cell suspensions in the presence of 0.1% DNase.

Oligodendrocytes and Myelinate Cells

EBs of some embodiments of the invention can differentiate to oligodendrocytes and myelinate cells by culturing the cells in modified SATO medium, i.e., DMEM with bovine serum albumin (BSA), pyruvate, progesterone, putrescine, thyroxine, triiodothyronine, insulin, transferrin, sodium selenite, amino acids, neurotrophin 3, ciliary neurotrophic factor and Hepes (Bottenstein, J. E. & Sato, G. H., 1979, Proc. Natl. Acad. Sci. USA 76, 514-517; Raff, M. C., Miller, R. H., & Noble, M., 1983, Nature 303: 390-396]. Briefly, EBs are dissociated using 0.25% Trypsin/EDTA (5 min at 37° C.) and triturated to single cell suspensions. Suspended cells are plated in flasks containing SATO medium supplemented with 5% equine serum and 5% fetal calf serum (FCS). Following 4 days in culture, the flasks are gently shaken to suspend loosely adhering cells (primarily oligodendrocytes), while astrocytes are remained adhering to the flasks and further producing conditioned medium. Primary oligodendrocytes are transferred to new flasks containing SATO medium for additional two days. Following a total of 6 days in culture, oligospheres are either partially dissociated and resuspended in SATO medium for cell transplantation, or completely dissociated and a plated in an oligosphere-conditioned medium which is derived from the previous shaking step [Liu, S. et al., (2000). Embryonic stem cells differentiate into oligodendrocytes and myelinate in culture and after spinal cord transplantation. Proc. Natl. Acad. Sci. USA. 97: 6126-6131].

Mast Cells

For mast cell differentiation, two-week-old EBs of some embodiments of the invention are transferred to tissue culture dishes including DMEM medium supplemented with 10% FCS, 2 mM L-glutamine, 100 units/ml penicillin, 100 mg/ml streptomycin, 20% (v/v) WEHI-3 cell-conditioned medium and 50 ng/ml recombinant rat stem cell factor (rrSCF, Tsai, M. et al., 2000. In vivo immunological function of mast cells derived from embryonic stem cells: An approach for the rapid analysis of even embryonic lethal mutations in adult mice in vivo. Proc Natl Acad Sci USA. 97: 9186-9190). Cultures are expanded weekly by transferring the cells to new flasks and replacing half of the culture medium.

Hemato-Lymphoid Cells

To generate hemato-lymphoid cells from the EBs of some embodiments of the invention, 2-3 days-old EBs are transferred to gas-permeable culture dishes in the presence of 7.5% C02 and 5% $O_2$ using an incubator with adjustable oxygen content. Following 15 days of differentiation, cells are harvested and dissociated by gentle digestion with Collagenase (0.1 unit/mg) and Dispase (0.8 unit/mg), both are available from F. Hoffman-La Roche Ltd, Basel, Switzerland. CD45-positive cells are isolated using anti-CD45 monoclonal antibody (mAb) M1/9.3.4.HL.2 and paramagnetic microbeads (Miltenyi) conjugated to goat anti-rat immunoglobulin as described in Potocnik, A. J. et al., (Immunology Hemato-lymphoid in vivo reconstitution potential of subpopulations derived from in vitro differentiated embryonic stem cells. Proc. Natl. Acad. Sci. USA. 1997, 94: 10295-10300). The isolated CD45-positive cells can be further enriched using a single passage over a MACS column (Miltenyi).

It will be appreciated that since EBs are complex structures, differentiation of EBs into specific differentiated cells, tissue or organ may require isolation of lineage specific cells from the EBs.

Such isolation may be effected by sorting of cells of the EBs via fluorescence activated cell sorter (FACS) or mechanical separation of cells, tissues and/or tissue-like structures contained within the EBs.

Methods of isolating EB-derived-differentiated cells via FACS analysis are known in the art. According to one method, EBs are disaggregated using a solution of Trypsin and EDTA (0.025% and 0.01%, respectively), washed with 5% fetal bovine serum (FBS) in phosphate buffered saline (PBS) and incubated for 30 min on ice with fluorescently-labeled antibodies directed against cell surface antigens characteristics to a specific cell lineage. For example, endothelial cells are isolated by attaching an antibody directed against the platelet endothelial cell adhesion molecule-1 (PECAM1) such as the fluorescently-labeled PECAM1 antibodies (30884X) available from PharMingen (PharMingen, Becton Dickinson Bio Sciences, San Jose, CA, USA) as described in Levenberg, S. et al., (Endothelial cells derived from human embryonic stem cells. Proc. Natl. Acad. Sci. USA. 2002. 99: 4391-4396). Hematopoietic cells are isolated using fluorescently-labeled antibodies such as CD34-FITC, CD45-PE, CD31-PE, CD38-PE, CD90-FITC, CD117-PE, CD15-FITC, class I-FITC, all of which IgG1 are available from PharMingen, CD133/1-PE (IgG1) (available from Miltenyi Biotec, Auburn, CA), and glycophorin A-PE (IgG1), available from Immunotech (Miami, FL). Live cells (i.e., without fixation) are analyzed on a FACScan (Becton Dickinson Bio Sciences) by using propidium iodide to exclude dead cells with either the PC-LYSIS or the CELL-QUEST software. It will be appreciated that isolated cells can be further enriched using magnetically-labeled second antibodies and magnetic separation columns (MACS, Miltenyi) as described by Kaufman, D. S. et al., (Hematopoietic colony-forming cells derived from human embryonic stem cells. Proc. Natl. Acad. Sci. USA. 2001, 98: 10716-10721).

An example for mechanical isolation of beating cardiomyocytes from EBs is disclosed in U.S. Patent Appl. No. 20030022367 to Xu et al. Briefly, four-day-old EBs of some embodiments of the invention are transferred to gelatin-coated plates or chamber slides and are allowed to attach and differentiate. Spontaneously contracting cells, which are observed from day 8 of differentiation, are mechanically separated and collected into a 15-mL tube containing low-calcium medium or PBS. Cells are dissociated using Collagenase B digestion for 60-120 minutes at 37° C., depending on the Collagenase activity. Dissociated cells are then resuspended in a differentiation KB medium (85 mM KCl, 30 mM $K_2HPO_4$, 5 mM $MgSO_4$, 1 mM EGTA, 5 mM creatine, 20 mM glucose, 2 mM $Na_2ATP$, 5 mM pyruvate, and 20 mM taurine, buffered to pH 7.2, Maltsev et al., Circ. Res. 75:233, 1994) and incubated at 37° C. for 15-30 min. Following dissociation cells are seeded into chamber slides and cultured in the differentiation medium to generate single cardiomyocytes capable of beating.

It will be appreciated that the culturing conditions suitable for the differentiation and expansion of the isolated lineage specific cells include various tissue culture medium, growth factors, antibiotic, amino acids and the like and it is within the capability of one skilled in the art to determine which conditions should be applied in order to expand and differentiate particular cell types and/or cell lineages [reviewed in Fijnvandraat A C, et al., Cardiovasc Res. 2003; 58: 303-12;

Sachinidis A, et al., Cardiovasc Res. 2003; 58: 278-91; Stavridis M P and Smith A G, 2003; Biochem Soc Trans. 31(Pt 1): 45-9].

In addition to the lineage-specific primary cultures, EBs of the invention can be used to generate lineage-specific cell lines which are capable of unlimited expansion in culture.

Cell lines of some embodiments of the invention can be produced by immortalizing the EB-derived cells by methods known in the art, including, for example, expressing a telomerase gene in the cells (Wei, W. et al., 2003. Mol Cell Biol. 23: 2859-2870) or co-culturing the cells with NIH 3T3 hph-HOX11 retroviral producer cells (Hawley, R. G. et al., 1994. Oncogene 9: 1-12).

Following are non-limiting examples of culturing conditions which are suitable for differentiating and/or expanding lineage specific cells from the naive PSCs or iPSCs of some embodiments of the invention. It should be noted that for inducing differentiation of the naive PSCs or iPSCs into differentiated cells, the medium which was used to maintain the cells in the naive undifferentiated and pluripotent state should be replaced with the appropriate differentiation medium.

Mesenchymal stromal cells which are CD73-positive and SSEA-4-negative can be generated from naive PSCs by mechanically increasing the fraction of fibroblast-like differentiated cells formed in cultures of naive hPSCs, essentially as described in Trivedi P and Hematti P. Exp Hematol. 2008, 36(3):350-9. Briefly, to induce differentiation of hESC the intervals between medium changes are increased to 3-5 days, and the cells at the periphery of the naive PSCs colonies become spindle-shaped fibroblast-looking cells. After 9-10 days under these conditions when about 40-50% of the cells in the culture acquire the fibroblast-looking appearance, the undifferentiated portions of naive PSCs colonies are physically removed and the remaining differentiated cells are passaged to new culture plates under the same conditions.

To induce differentiation of naive hPSCs into dopaminergic (DA) neurons, the cells can be co-cultured with the mouse stromal cell lines PA6 or MS5, or can be cultured with a combination of stromal cell-derived factor 1 (SDF-1/CXCL12), pleiotrophin (PTN), insulin-like growth factor 2 (IGF2) and ephrin B1 (EFNB1) essentially as described in Vazin T, et al., PLoS One. 2009 Aug. 12; 4(8):e6606; and in Elkabetz Y., et al., Genes Dev. 2008 Jan. 15; 22: 152-165.

To generate mesencephalic dopamine (mesDA) neurons, naive hPSCs can be genetically modified to express the transcription factor Lmx1a (e.g., using a lentiviral vector with the PGK promoter and Lmx1a) essentially as described in Friling S., et al., Proc Natl Acad Sci USA. 2009, 106: 7613-7618.

To generate lung epithelium (type II pneumocytes) from naive hPSCs, the naive PSCs can be cultured in the presence of a commercially available cell culture medium (Small Airway Growth Medium; Cambrex, College Park, MD), or alternatively, in the presence of a conditioned medium collected from a pneumocyte cell line (e.g., the A549 human lung adenocarcinoma cell line) as described in Rippon H J., et al., Proc Am Thorac Soc. 2008; 5: 717-722.

To induce differentiation of naive hPSCs cells into neural cells, the pluripotent stem cells can be cultured for about 5 days in the presence of a serum replacement medium supplemented with TGF-b inhibitor (SB431542, Tocris; e.g., 10 nM) and Noggin (R&D; e.g., 500 ng/ml), following which the cells are cultured with increasing amounts (e.g., 25%, 50%, 75%, changed every two days) of N2 medium (Li X J., et al., Nat Biotechnol. 2005, 23:215-21) in the presence of 500 ng/mL Noggin, essentially as described in Chambers S M., et al., Nat Biotechnol. 2009, 27: 275-280.

The invention, according to some embodiments thereof, contemplates the use of cells, tissues and organs generated from the naive pluripotent stem cells of the invention using any differentiation protocol known in the art.

It will be appreciated that since the lineage-specific cells or cell lines obtained according to the teachings of some embodiments of the invention are developed by differentiation processes similar to those naturally occurring in the human embryo they can be further used for human cell-based therapy and tissue regeneration.

Thus, the invention according to some embodiments thereof envisages the use of the expanded and/or differentiated lineage-specific cells or cell lines of some embodiments of the invention for treating a disorder requiring cell replacement therapy.

For example, diseases presently expected to be treatable by therapeutic transplantation of PSC or PSC-derived cells include Parkinson's disease, cardiac infarcts, juvenile-onset diabetes mellitus, and leukemia (Gearhart J. Science 1998, 282:1061; Rossant and Nagy, Nature Biotech. 1999, 17:23).

For example, oligodendrocyte precursors can be used to treat myelin disorders (Repair of myelin disease: Strategies and progress in animal models. Molecular Medicine Today. 1997. pp. 554-561), chondrocytes or mesenchymal cells can be used in treatment of bone and cartilage defects (U.S. Pat. No. 4,642,120) and cells of the epithelial lineage can be used in skin regeneration of a wound or burn (U.S. Pat. No. 5,716,411).

For certain disorders, such as genetic disorders in which a specific gene product is missing [e.g., lack of the CFTR gene-product in cystic fibrosis patients (Davies J C, 2002. New therapeutic approaches for cystic fibrosis lung disease. J. R. Soc. Med. 95 Suppl 41:58-67)], PSC-derived cells are preferably manipulated to over-express the mutated gene prior to their administration to the individual. It will be appreciated that for other disorders, the PSC-derived cells should be manipulated to exclude certain genes.

Over-expression or exclusion of genes can be effected using knock-in and/or knock-out constructs [see for example, Fukushige, S. and Ikeda, J. E.: Trapping of mammalian promoters by Cre-lox site-specific recombination. DNA Res 3 (1996) 73-50; Bedell, M. A., Jerkins, N. A. and Copeland, N. G.: Mouse models of human disease. Part I: Techniques and resources for genetic analysis in mice. Genes and Development 11 (1997) 1-11; Bermingham, J. J., Scherer, S. S., O'Connell, S., Arroyo, E., Kalla, K. A., Powell, F. L. and Rosenfeld, M. G.: Tst-1/Oct-6/SCIP regulates a unique step in peripheral myelination and is required for normal respiration. Genes Dev 10 (1996) 1751-62].

In addition to cell replacement therapy, the lineage specific cells of some embodiments of the invention can also be utilized to prepare a cDNA library. mRNA is prepared by standard techniques from the lineage specific cells and is further reverse transcribed to form cDNA. The cDNA preparation can be subtracted with nucleotides from embryonic fibroblasts and other cells of undesired specificity, to produce a subtracted cDNA library by techniques known in the art.

The lineage specific cells of some embodiments of the invention can be used to screen for factors (such as small molecule drugs, peptides, polynucleotides and the like) or conditions (such as culture conditions or manipulation) that affect the differentiation of lineage precursor to terminally differentiated cells. For example, growth affecting substances, toxins or potential differentiation factors can be tested by their addition to the culture medium.

The naïve pluripotent stem cells, generated as described herein, can be used as a starting material for the generation of primordial cells.

Thus, according to another aspect of some embodiments of the invention, there is provided a method of generating a primordial germ cell, comprising culturing primate naive pluripotent stem cells in a culture medium selected capable of inducing the primate naive pluripotent stem cells into primordial germ cell.

According to a particular embodiment, the culture medium comprises a Rho kinase (ROCK) inhibitor and bone morphogenetic protein 4 (BMP4).

According to some embodiments of the invention, the primate naive pluripotent stem cell comprises:
- an unmethylated X-inactive specific transcript (XIST) gene, wherein:
  - (i) when the naive PSC is a female PSC, then the naive female PSC has two unmethylated alleles of the promoter of the XIST gene; and
  - (ii) when the naive PSC is a male PSC, then the naive male PSC has an unmethylated allele of the promoter of the XIST gene; and/or
- an expression level of transcription factor E3 (TFE3) characterized by a nucleus to cytoplasm expression ratio which is equal to or higher than 1 as determined by an immunostaining assay.

According to some embodiments of the invention, the primordial germ cell is characterized by a CD61 (integrin beta 3) positive expression pattern.

According to some embodiments of the invention, the primordial germ cell is characterized by a $CD61^+/SSEA4^+$ expression pattern (expression signature).

According to some embodiments of the invention, the culture medium selected capable of inducing the primate naive pluripotent stem cells into primordial germ cell further comprises at least one agent selected from the group consisting of: leukemia inhibitory factor (LIF), Stem Cell Factor (SCF) and Epidermal Growth Factor (EGF).

According to an aspect of some embodiments of the invention, there is provided an isolated population of primate primordial germ cells comprising primate primordial germ cells generated according to the method of some embodiments of the invention.

According to some embodiments of the invention, the isolated population of primate primordial germ cells comprising at least about 50%, e.g., at least about 60%, e.g., at least about 70%, e.g., at least about 80%, e.g., at least about 90%, e.g., at least about 95%, e.g., at least about 99%, e.g., 100% of primordial germ cells characterized by $CD61^+/SSEA4^+$ expression pattern.

It should be noted that the isolated primordial germ cells (PGCs) of some embodiments of the invention can be injected into adult human testis or ovary to complete their maturation and generate sperm or eggs.

According to an aspect of some embodiments of the invention, there is provided a method of treating a subject in need thereof, comprising administering the primordial germ cells of some embodiments of the invention to a gonad tissue of the subject, thereby treating the subject in need thereof.

The term "subject" refers to a mammal, e.g., a primate, preferably a human being at any age which suffer from the pathology.

The term "treating" refers to inhibiting, preventing or arresting the development of a pathology (disease, disorder or condition) and/or causing the reduction, remission, or regression of a pathology. Those of skill in the art will understand that various methodologies and assays can be used to assess the development of a pathology, and similarly, various methodologies and assays may be used to assess the reduction, remission or regression of a pathology.

According to some embodiments of the invention, the subject suffers from infertility.

According to an aspect of some embodiments of the invention, there is provided a kit comprising the primate primordial germ cells of some embodiments of the invention and a medicament for treating infertility.

The kit may also include appropriate buffers and preservatives for improving the shelf-life of the kit.

The kit may include appropriate instructions for use and labels indicating FDA approval for use in treating a subject, such as treating infertility in the subject.

The isolated naïve PSC of some embodiments of the invention may be used for generation of a chimeric human-mouse organism, and to contribute to development of mouse embryo in vivo, essentially as described elsewhere (Gafni et al. Nature 2013 Dec. 12; 504(7479):282-6. doi: 10.1038/nature12745. Epub 2013 Oct. 30, which is fully incorporated herein by reference).

The present inventors have uncovered that specific genetic modification(s) of the donor cells (e.g., of the isolated naïve pluripotent stem cell of some embodiments of the invention, primed PSC, or the primordial germ cell of some embodiments of the invention) can improve the efficiency of generation of a chimeric animal. For example, over expression of an oncogenic protein selected from the group consisting of: C-MYC, N-MYC, L-MYC, EDAR (ectodysplasin A receptor), MDM2, and ERAS, and/or downregulation of a tumor suppressor protein selected from the group consisting of P53 and NF kappa B inhibitor alpha in the donor cells can improve the generation of a chimeric animal.

Thus, according to an aspect of some embodiments of the invention there is provided an isolated naïve pluripotent stem cell genetically modified to over-express an oncogenic protein selected from the group consisting of: C-MYC, N-MYC, L-MYC, EDAR (ectodysplasin A receptor), MDM2, and ERAS, and/or to downregulate a tumor suppressor protein selected from the group consisting of P53 and NF kappa B inhibitor alpha.

For example, as described in Example 8 and shown in FIG. 24A, the present inventors were capable of generating cross-species chimeric humanized mice by microinjection of LIS 38 EGFP hTP53 C2 naive human iPS cells (which were used as the human donor cells) into mouse morulas (which were used as host cells).

Over-expression of an oncogenic protein can be performed by upregulating an endogenous expression of the oncogenic protein in the cell (e.g., adding and/or replacing promoter and/or enhancer elements, and/or introducing molecules which increase endogenous expression of the oncogene, e.g., a small molecule), and/or by expression of a heterologous polynucleotide encoding at least the functional portion of the oncogenic protein(s) described hereinbelow using a nucleic acid construct (or expression vector) as is further described herein under.

As used herein the term "C-MYC" (also known as MRTL; MYCC; c-Myc; bHLHe39) refers to the oncogenic protein which is the v-myc avian myelocytomatosis viral oncogene homolog from *Homo sapiens* (Gene ID 4609), e.g., to the protein set forth by GenBank Accession No. NP_002458.2 (SEQ ID NO: 204). Overexpression of the c-MYC can be performed by expression of a heterologous polynucleotide comprising the nucleic acid sequence set forth by GenBank Accession No. NG_007161.1 (SEQ ID NO:213) or a functional portion thereof, e.g., a nucleic acid sequence encoding amino acids 1-454 of GenBank Accession No. NP_002458.2 (SEQ ID NO: 204).

As used herein the term "N-MYC" (also known as MYCN, NMYC; ODED; MODED; N-myc; bHLHe37) refers to the oncogenic protein v-myc avian myelocytomatosis viral oncogene neuroblastoma derived homolog from *Homo sapiens* (Gene ID 4613), e.g., to the protein set forth by GenBank Accession No. NP_001280157.1 (SEQ ID NO:205). Overexpression of the N-MYC can be performed by expression of a heterologous polynucleotide comprising the nucleic acid sequence set forth by GenBank Accession No. NG_007457.1 (SEQ ID NO:214) or a functional portion thereof, e.g., a nucleic acid sequence encoding amino acids 1-464 of GenBank Accession No. NP_001280157.1 (SEQ ID NO:205).

As used herein the term "L-MYC" (also known as LMYC; L-Myc; MYCL1; bHLHe38) refers to the oncogenic protein v-myc avian myelocytomatosis viral oncogene lung carcinoma derived homolog from *Homo sapiens* (Gene ID 4610) e.g., to the protein set forth by GenBank Accession No. NP_001028253.1 isoform 1 (SEQ ID NO:206). Overexpression of the L-MYC can be performed by expression of a heterologous polynucleotide comprising the nucleic acid sequence set forth by GenBank Accession No. NM_001033081.2 (SEQ ID NO:215) or a functional portion thereof, e.g., a nucleic acid sequence encoding amino acids 1-365 of GenBank Accession No. NP_001028253.1 isoform 1 (SEQ ID NO:206).

As used herein the term "EDAR" (also known as DL; ED3; ED5; ED1R; EDA3; HRM1; EDA1R; ECTD10A; ECTD10B; EDA-A1R) refers to the oncogenic protein ectodysplasin A receptor from *Homo sapiens* (Gene ID 10913), e.g., to the protein set forth by GenBank Accession No. NP_071731.1 (SEQ ID NO:207). Overexpression of the EDAR can be performed by expression of a heterologous polynucleotide comprising the nucleic acid sequence set forth by GenBank Accession No. NG_008257.1 (SEQ ID NO:216) or a functional portion thereof, e.g., a nucleic acid sequence encoding amino acids 1-484 of GenBank Accession No. NP_071731.1 (SEQ ID NO:207).

As used herein the term "MDM2" (also known as HDMX; hdm2; ACTFS) refers to the proto-oncogene, E3 ubiquitin protein ligase from *Homo sapiens* (Gene ID 4193; GenBank: GQ848196.1), e.g., to the protein set forth by GenBank Accession No. ACX31156.1 (SEQ ID NO:208). Overexpression of the MDM2 can be performed by expression of a heterologous polynucleotide comprising the nucleic acid sequence set forth by GenBank Accession No. GQ848196.1 (SEQ ID NO:217) or a functional portion thereof, e.g., a nucleic acid sequence encoding amino acids 1-466 of GenBank Accession No. ACX31156.1 (SEQ ID NO:208).

As used herein the term "ERAS" (also known as HRAS2; HRASP) refers to the ES cell expressed Ras from *Homo sapiens* Gene ID 3266), e.g., to the protein set forth by GenBank Accession No. NP_853510.1 (SEQ ID NO: 209). Overexpression of the ERAS can be performed by expression of a heterologous polynucleotide comprising the nucleic acid sequence set forth by GenBank Accession No. NM_181532.3 (SEQ ID NO:218) or a functional portion thereof, e.g., a nucleic acid sequence encoding amino acids 1-233 of GenBank Accession No. NP_853510.1 (SEQ ID NO: 209).

Downregulation of a tumor suppressor protein can be achieved by various modes.

As used herein the term "P53" (also known as TP53; BCC7; LFS1; TRP53) refers to the tumor protein P53 (Gene ID: 7157), such as the protein set forth by GenBank Accession No. BAC16799.1 (SEQ ID NO:210).

As used herein the term "NF kappa B inhibitor alpha" (NFKBIA, also known as IKBA; MAD-3; NFKBI) refers to the nuclear factor of kappa light polypeptide gene enhancer in B-cells inhibitor, alpha from *Homo sapiens* (Gene ID: 4792), e.g., the protein set forth by GenBank Accession No. NP_065390.1 (SEQ ID NO:211).

Downregulation of the tumor suppressor protein of some embodiments of the invention (e.g., P53 and/or NF kappa B inhibitor alpha) can be effected on the genomic and/or the transcript level using a variety of molecules which interfere with transcription and/or translation [e.g., RNA silencing agents (e.g., antisense, siRNA, shRNA, micro-RNA), Ribozyme and DNAzyme or using a dominant negative mutant]. It should be noted that the downregulation can be a complete absence of protein production and/or a complete inhibition of protein activity, or it can be a partial inhibition of protein production and/or activity. In addition, it should be noted that the downregulation can be permanent or transient, depending on the cell in which downregulation occurs and in the purpose of the downregulation, and/or on the effect of the downregulation of the tumor suppressor protein on the cell or on the generated chimeric animal. Description of the downregulation agents is provided herein under.

P53 dominant negative mutant is described as a mutated mouse or human p53 protein that suppresses endogenous p53 activity in a dominant-negative fashion by forming mixed tetramers with wild-type mouse or human p53, and thus reducing p53 binding to the p53-responsive element in its target genes (described in de Vries et al., 2002. Proc. Natl. Acad. Sci. U.S.A. 99(5):2948-53; Willis et al., 2004 (Oncogene 23, 2330-2338, each of which is fully incorporated herein by reference in its entirety).

Non-limiting examples of P53 dominant negative mutants which can be used to downregulate P53 in the cells of some embodiments of the invention include:

A). R172H dominant negative mutant in the mouse P53 protein set forth by GenBank: AAA39883.1 (SEQ ID NO: 212), essentially as described in de Vries et al., 2002 (Proc. Natl. Acad. Sci. U.S.A. 99(5):2948-53); Willis et al., 2004 (Oncogene, 23, 2330-2338). It should be noted that according to the accepted nomenclature for genetic mutations, the "R172H" refers to substitution of "R" amino acid (i.e., Argnine) at position 172 of the sequence depicted in GenBank: AAA39883.1 (SEQ ID NO: 212) with an "H" amino acid (i.e., histidine).

B). R175H, G245S, R248W, R249S, R273H or R282W dominant negative mutants in the human P53 protein set forth by GenBank Accession No. BAC16799.1 (SEQ ID NO:210), essentially as described in Petitjean A et al., Hum Mutat. 2007 June; 28(6):622-9." Impact of mutant p53 functional properties on TP53 mutation patterns and tumor phenotype: lessons from recent developments in the IARC TP53 database"; and in Freed-Pastor W A et al., Genes Dev. 2012 Jun. 15; 26(12):1268-86. "Mutant p53: one name, many proteins"), each of which is fully incorporated herein by its entirety.

A dominant negative mutant of NF-kappa-B inhibitor alpha, which acts like an oncogene and inhibits P53 function, was made by changing both S32 and S36 amino acid residues into either D (aspartic acid—Asp) or E (glutamic acid—Glu) (Zhou M. et al., 2003. "Transfection of a dominant-negative mutant NF-kB inhibitor (IkBm) represses p53-dependent apoptosis in acute lymphoblastic leukemia cells: interaction of IkBm and p53." Oncogene. 22(50): 8137-44).

According to some embodiments of the invention, the NF kappa B inhibitor alpha dominant negative mutant which can be used to downregulate NF kappa B inhibitor alpha in the cell of some embodiments of the invention comprises the S32D and S36D mutations in the human NF-kappa-B inhibitor alpha protein set forth in SEQ ID NO:211 [meaning substitution of the "S" (Serine) amino acid at position 32 with the "D" (Aspartic Acid) amino acid, and substitution of the "S" amino acid at position 36 with "D" amino acid].

According to some embodiments of the invention, the NF kappa B inhibitor alpha dominant negative mutant which can be used to downregulate NF kappa B inhibitor alpha in the cell of some embodiments of the invention comprises the S32E and S36E mutations in the human NF-kappa-B inhibitor alpha protein set forth in SEQ ID NO:211 [meaning substitution of the "S" (Serine) amino acid at position 32 with the "E" (Glutamic Acid) amino acid, and substitution of the "S" amino acid at position 36 with "E" amino acid].

According to some embodiments of the invention, the NF kappa B inhibitor alpha dominant negative mutant which can be used to downregulate NF kappa B inhibitor alpha in the cell of some embodiments of the invention comprises the S32D and S36E mutations in the human NF-kappa-B inhibitor alpha protein set forth in SEQ ID NO:211 [meaning substitution of the "S" (Serine) amino acid at position 32 with the "D" (Aspartic Acid) amino acid, and substitution of the "S" amino acid at position 36 with "E" (Glutamic Acid)].

According to some embodiments of the invention, the NF kappa B inhibitor alpha dominant negative mutant which can be used to downregulate NF kappa B inhibitor alpha in the cell of some embodiments of the invention comprises the S32E and S36D mutations in the human NF-kappa-B inhibitor alpha protein set forth in SEQ ID NO:211 [meaning substitution of the "S" (Serine) amino acid at position 32 with the "E" (Glutamic Acid) amino acid, and substitution of the "S" amino acid at position 36 with "D" amino acid].

According to some embodiments of the invention, the genetically modified isolated naïve pluripotent stem cell of some embodiments of the invention is characterized as follows:
wherein
(i) when said naive PSC is a female PSC, then said naive female PSC has two unmethylated alleles of the promoter of the X-inactive specific transcript (XIST) gene; and
(ii) when said naive PSC is a male PSC, then said naive male PSC has an unmethylated allele of said promoter of said XIST gene,
and/or
an expression level of transcription factor E3 (TFE3) in said naive PSC is characterized by a nucleus to cytoplasm expression ratio which is equal to or higher than 1 as determined by an immunostaining assay,
and/or
the naïve PSC is characterized by a positive expression of C-KIT (CD117) on the cell surface of the naïve PSC.

According to some embodiments of the invention, the genetically modified naïve pluripotent stem cell is a primate cell.

According to some embodiments of the invention, the genetically modified naïve pluripotent stem cell is a human cell.

According to an aspect of some embodiments of the present invention there is provided a method of generating a chimeric animal comprising introducing the isolated naïve pluripotent stem cell of some embodiments of the invention, or the primordial germ cells of some embodiments of the invention, into an embryo of a host animal, thereby generating the chimeric animal.

According to some embodiments of the invention, the isolated naïve pluripotent stem cell which is used for generating the chimeric animal is genetically modified to overexpress an oncogenic protein selected from the group consisting of: C-MYC, N-MYC, L-MYC, EDAR (ectodysplasin A receptor), MDM2, and ERAS, and/or to downregulate a tumor suppressor protein selected from the group consisting of P53 and NF kappa B inhibitor alpha.

As used herein, the phrase "chimeric animal" refers to an animal comprising cells of at least two genetically distinct individuals.

It is noted that the chimeric animal can be composed of cells of two different individuals belonging to two different species, or to the same species.

According to some embodiments of the invention, the isolated naïve pluripotent stem cell or the primordial germ cell is allogeneic to the host animal.

As used herein, the term "allogeneic" refers to at least two genetically different individuals of the same species.

According to some embodiments of the invention, the isolated naïve pluripotent stem cell or the primordial germ cell is xenogeneic to the host animal.

As used herein, the term "xenogeneic" refers to at least two individuals of different species.

According to some embodiments of the invention, the host animal is a primate, e.g., a mammal.

According to some embodiments of the invention, the host animal is mouse.

According to some embodiments of the invention, the host animal is pig.

According to some embodiments of the invention, the host animal is monkey.

According to some embodiments of the invention, the host animal is chimpanzee.

According to some embodiments of the invention, the host animal is not human.

According to some embodiments of the invention, the embryo is a pre-implantation embryo.

As used herein, the term "pre-implantation embryo" refers to an embryo at an 8-cell stage, 16-cell stage embryo, early morula, late morula, early blastocyst, and/or a late blastocyst.

It should be noted that since the isolated naïve pluripotent stem cells or the primordial germ cells are introduced into the pre-implantation embryo they are likely to form a normal embryo.

According to some embodiments of the invention, the pre-implantation embryo comprises at least 4 cells.

According to some embodiments of the invention, the pre-implantation embryo comprises no more than 128 cells.

According to some embodiments of the invention, introducing the donor cell to the host animal is performed in vivo.

Methods of in vivo administration of cells into a morula of an animal are well known in the art, such as in Gafni O, Weinberger L, Mansour A A, Manor Y S, Chomsky E, Ben-Yosef D, Kalma Y, Viukov S, Maza I, Zviran A, Rais Y, Shipony Z, Mukamel Z, Krupalnik V, Zerbib M, Geula S, Caspi I, Schneir D, Shwartz T, Gilad S, Amann-Zalcenstein D, Benjamin S, Amit I, Tanay A, Massarwa R, Novershtern N, Hanna J H. Nature. 2013 Dec. 12; 504 (7479):282-6. doi:

10.1038/nature12745. Epub 2013 Oct. 30; and *Manipulating the Mouse Embryo*: A Laboratory Manual, Fourth Edition. By Richard Behringer; Marina Gertsenstein; Kristina Vintersten Nagy; Andras Nagy, each of which is fully incorporated herein by reference.

According to some embodiments of the invention, introducing the donor cells (e.g., the isolated naïve pluripotent stem cell of some embodiments of the invention, or the primordial germ cells of some embodiments of the invention) into an embryo of a host animal is performed by microinjection of the donor cells into host early pre-implantation embryos.

According to some embodiments of the invention, the morula comprises at least 4 cells.

According to some embodiments of the invention, the morula comprises no more than 128 cells.

According to some embodiments of the invention, the introducing is performed in vitro or ex vivo.

According to some embodiments of the invention, introducing the cells is performed in vitro or ex vivo via direct injection or aggregation with the developing host embryo.

According to some embodiments of the invention, introducing the donor cells (e.g., the isolated naïve pluripotent stem cell of some embodiments of the invention, or the primordial germ cells of some embodiments of the invention) into an embryo of a host animal is performed by aggregation (e.g., for a few hours, or overnight) of the donor cells with a host pre-implantation embryos.

According to some embodiments of the invention, the method further comprising allowing the pre-implantation embryo to grow ex vivo or in vivo.

According to some embodiments of the invention, the method further comprising testing a level of chimerism in the chimeric animal.

Once formed, the level of chimerism in the chimeric animal can be evaluated by various means which follow the donor cells within the host cells. This can be achieved by, for example, genetically modifying the donor cells (prior to their introducing into the host animal) to express a trackable label (a reporter protein), such as to express a fluorescent protein [e.g., red fluorescent protein (RFP) (SEQ ID NO: 222 (for DNA) and SEQ ID NO: 221 (for protein)), green fluorescent protein (GFP) (SEQ ID NO: 220 (for DNA) and SEQ ID NO: 219 (for protein)) and the like, the sequences of which are well known and available via the NCBI web site (ncbi (dot) nlm (dot) nih (dot) gov], which can be viewed using a fluorescent microscope. See e.g., FIGS. 24A-B herein.

As used herein Methods of genetically modifying cells to express a protein-of-interest (e.g., a fluorescent protein) are known in the art, and are further described herein under.

Thus, one can easily evaluate the efficiency of generation of chimeric animals. Briefly, after the donor cells are introduced into the host animal, the developing embryos can be viewed using a fluorescent microscope and fluorescently-labeled embryos are counted out of the total number of injected embryos.

In addition, in each embryo, the number of donor cells (e.g., which are labeled with GFP) is counted per each chimeric animal.

It should be noted that using the genetically modified naive PSCs of some embodiments of the invention, with downregulated P53 (due to the dominant negative P53) the present inventors were capable of obtaining chimeric animals at a success rate of at least 20%, wherein the average percentage of donor cells within each chimeric animal was between about 10% to about 49% (FIGS. 24A-B and data not shown).

According to an aspect of some embodiments of the present invention there is provided a cell culture comprising the isolated genetically modified naïve pluripotent stem cell of some embodiments of the invention and a culture medium.

According to some embodiments of the invention, the culture medium is capable of maintaining said pluripotent stem cell in a naïve state for at least 5 passages, e.g., at least about 10, 15, 20, 25, 30, 40, 50, 100, 200, 500, 1000, e.g., 3000 passages.

According to some embodiments of the invention, the culture medium included in the cell culture of the invention is any of the culture media described herein.

According to some embodiments of the invention, the culture medium included in the cell culture of the invention is the culture medium of some embodiments of the invention.

According to some embodiments of the invention, the culture medium included in the cell culture of the invention is any of the culture media 1-147.

According to some embodiments of the invention, the culture medium included in the cell culture of the invention is any of the culture media described in WO2014/174470 which is fully incorporated herein by reference in its entirety.

According to some embodiments of the invention, the culture medium included in the cell culture of the invention comprises an ERK1/2 inhibitor, a GSK3β inhibitor, a p38 inhibitor, a JNK inhibitor, a STAT3 activator and at least one agent selected from the group consisting of: basic fibroblast growth factor (bFGF), transforming growth factor beta 1 (TGFβ1), a protein kinase C (PKC) inhibitor, a ROCK inhibitor and a NOTCH inhibitor.

According to some embodiments of the invention, the culture medium included in the cell culture of the invention comprises an ERK1/2 inhibitor, a GSK3β inhibitor, a p38 inhibitor, a JNK inhibitor, a STAT3 activator and at least one agent selected from the group consisting of: a transforming growth factor receptor (TGFR) inhibitor, a fibroblast growth factor receptor (FGFR) inhibitor, a protein kinase C (PKC) inhibitor, a ROCK inhibitor and a NOTCH inhibitor.

According to some embodiments of the invention the STAT3 activator is selected from the group consisting of leukemia inhibitory factor (LIF) and interleukin 6 (IL6).

According to some embodiments of the invention the culture medium further comprising at least one additional agent selected from the group consisting of: insulin-like growth factor 1 (IGF1), insulin-like growth factor II (IGFII), a bone morphogenetic protein (BMP) signaling inhibitor, a Sonic Hedgehog pathway (SHH) inhibitor, an ERK5 inhibitor, Forskolin, Kenpaullone, BayK8644, Bix01294, and stem cell factor (SCF).

According to some embodiments of the invention the culture medium further comprising at least one additional agent selected from the group consisting of: insulin-like growth factor 1 (IGF1), insulin-like growth factor II (IGFII), bone morphogenetic protein 4 (BMP4), a Sonic Hedgehog pathway (SHH) inhibitor, an ERK5 inhibitor, Forskolin, Kenpaullone, BayK8644, Bix01294, and stem cell factor (SCF).

According to some embodiments of the invention, the STAT3 activator comprises the LIF, and wherein the at least one agent comprises the PKC inhibitor.

According to some embodiments of the invention, the STAT3 activator comprises the LIF, and wherein the at least one agent comprises the TGFβ1 and the protein kinase C inhibitor.

According to some embodiments of the invention, the culture medium further comprises an FGFR inhibitor.

According to some embodiments of the invention, the culture medium further comprises TGFR inhibitor.

According to some embodiments of the invention, the STAT3 activator comprises the LIF and wherein the at least one agent comprises the TGFβ1 and the protein kinase C inhibitor.

According to some embodiments of the invention, the culture medium further comprises an FGFR inhibitor.

According to some embodiments of the invention, the STAT3 activator comprises the LIF, and wherein the at least one agent comprises the bFGF and the TGFβ1.

According to some embodiments of the invention, the culture medium further comprises a ROCK inhibitor.

According to some embodiments of the invention, the culture medium further comprises a protein kinase C inhibitor.

According to some embodiments of the invention, the STAT3 activator comprises the LIF and wherein the at least one agent comprises the bFGF, the ROCK inhibitor, a bone morphogenetic protein (BMP) inhibitor, the NOTCH inhibitor, and a transforming growth factor receptor (TGFR) inhibitor.

According to some embodiments of the invention, the culture medium further comprises a Sonic Hedgehog pathway (SHH) inhibitor.

According to some embodiments of the invention, the STAT3 activator comprises the LIF and wherein the at least one agent comprises the NOTCH inhibitor, and a fibroblast growth factor receptor (FGFR) inhibitor.

According to some embodiments of the invention, the culture medium further comprises an agent selected from the group consisting of insulin-like growth factor II (IGFII), stem cell factor (SCF) and transforming growth factor beta 1 (TGFβ1).

According to an aspect of some embodiments of the present invention there is provided a culture medium comprising leukemia inhibitor factor (LIF), an ERK1/2 inhibitor, a GSK3b inhibitor, a p38 inhibitor, a JNK inhibitor, and a protein kinase C inhibitor.

According to some embodiments of the invention, the culture medium of some embodiments of the invention further comprises an FGFR inhibitor.

According to some embodiments of the invention, the culture medium of some embodiments of the invention further comprises a TGFR inhibitor.

According to an aspect of some embodiments of the present invention there is provided a culture medium comprising leukemia inhibitor factor (LIF), an ERK1/2 inhibitor, a GSK3b inhibitor, a p38 inhibitor, a JNK inhibitor, TGFβ1 and a protein kinase C inhibitor.

According to some embodiments of the invention, the culture medium of some embodiments of the invention further comprises a FGFR inhibitor.

According to an aspect of some embodiments of the present invention there is provided a culture medium comprising leukemia inhibitor factor (LIF), an ERK1/2 inhibitor, a GSK3b inhibitor, a p38 inhibitor, a JNK inhibitor, basic fibroblast growth factor (bFGF) and transforming growth factor-beta 1 (TGFβ1).

According to some embodiments of the invention, the culture medium of some embodiments of the invention further comprises a ROCK inhibitor.

According to some embodiments of the invention, the culture medium of some embodiments of the invention further comprises a protein kinase C inhibitor.

According to some embodiments of the invention, the culture medium of some embodiments of the invention further comprising a factor selected from the group consisting of: bone morphogenetic protein 4 (BMP4), IGF1, IGFII, Forskolin, FGFR inhibitor, TGFR inhibitor, Kenpaullone, BayK8644, Bix01294, and stem cell factor (SCF).

According to some embodiments of the invention, the culture medium of some embodiments of the invention further comprising BMP type I receptors (ALK2,3,6) inhibitor.

According to some embodiments of the invention, the culture medium of some embodiments of the invention further comprises ascorbic Acid.

According to some embodiments of the invention, the culture medium of some embodiments of the invention further comprises oleic Acid.

According to some embodiments of the invention, the culture medium of some embodiments of the invention further comprises Linoleic Acid.

According to some embodiments of the invention, the culture medium of some embodiments of the invention further comprises Pipecolic Acid.

According to some embodiments of the invention, the culture medium of some embodiments of the invention being devoid of animal serum.

According to some embodiments of the invention, the culture medium of some embodiments of the invention further comprises serum replacement.

It should be noted that once the chimeric animal is formed, and allowed to grow, the cells of the chimeric animal can be used for cell therapy. For example, the mature differentiated cells (e.g., hematopoietic stem cells, liver hepatocytes, insulin producing Beta cells) generated in the chimeric animal based on some embodiments of the invention can be used for transplantation in adult humans or for biomedical applications.

Thus, according to an aspect of some embodiments of the invention, there is provided a method of isolating differentiated cells, cell lineages, tissues or organs from the chimeric animal of some embodiments of the invention.

Methods of isolating such differentiated cells, tissues or organs are well known in the art and are also described hereinabove.

Thus, in case the naive PSCs that were used to form the chimeric animal are human cells, these cells can be further isolated from the formed chimeric animal and used for treating a human subject.

According to some embodiments of the invention, the method further comprises isolating human-derived (human-originated) cells or tissues from the chimeric animal.

Non-limiting examples of using such human-originated cells, tissues or organs include cell based therapy, tissue replacement, organ or tissue implantation.

Following is a non-limiting description of expression vectors and modes of administering thereof into cells which can be used to express a polypeptide-of-interest (e.g., any of the proteins described hereinabove, e.g., OCT4, c-MYC, SOX2, KLF4, LIF, bFGF, TGFβ1, an oncogenic protein such as C-MYC, N-MYC, L-MYC, EDAR (ectodysplasin A receptor), MDM2, and ERAS, a reporter protein such as GFP or RFP) in a cell.

To express an exogenous protein in mammalian cells, a polynucleotide sequence encoding the polypeptide-of-interest is preferably ligated into a nucleic acid construct suitable for mammalian cell expression. Such a nucleic acid construct includes a promoter sequence for directing transcription of the polynucleotide sequence in the cell in a constitutive or inducible manner.

The nucleic acid construct (also referred to herein as an "expression vector") of some embodiments of the invention includes additional sequences which render this vector suitable for replication and integration in prokaryotes, eukaryotes, or preferably both (e.g., shuttle vectors). In addition, a typical cloning vectors may also contain a transcription and translation initiation sequence, transcription and translation terminator and a polyadenylation signal. By way of example, such constructs will typically include a 5' LTR, a tRNA binding site, a packaging signal, an origin of second-strand DNA synthesis, and a 3' LTR or a portion thereof.

The nucleic acid construct of some embodiments of the invention typically includes a signal sequence for secretion of the peptide from a host cell in which it is placed. Preferably the signal sequence for this purpose is a mammalian signal sequence or the signal sequence of the polypeptide variants of some embodiments of the invention.

Eukaryotic promoters typically contain two types of recognition sequences, the TATA box and upstream promoter elements. The TATA box, located 25-30 base pairs upstream of the transcription initiation site, is thought to be involved in directing RNA polymerase to begin RNA synthesis. The other upstream promoter elements determine the rate at which transcription is initiated.

Enhancer elements can stimulate transcription up to 1,000 fold from linked homologous or heterologous promoters. Enhancers are active when placed downstream or upstream from the transcription initiation site. Many enhancer elements derived from viruses have a broad host range and are active in a variety of tissues. For example, the SV40 early gene enhancer is suitable for many cell types. Other enhancer/promoter combinations that are suitable for some embodiments of the invention include those derived from polyoma virus, human or murine cytomegalovirus (CMV), the long term repeat from various retroviruses such as murine leukemia virus, murine or Rous sarcoma virus and HIV. See, Enhancers and Eukaryotic Expression, Cold Spring Harbor Press, Cold Spring Harbor, N.Y. 1983, which is incorporated herein by reference.

In the construction of the expression vector, the promoter is preferably positioned approximately the same distance from the heterologous transcription start site as it is from the transcription start site in its natural setting. As is known in the art, however, some variation in this distance can be accommodated without loss of promoter function.

Polyadenylation sequences can also be added to the expression vector in order to increase the efficiency of mRNA translation. Two distinct sequence elements are required for accurate and efficient polyadenylation: GU or U rich sequences located downstream from the polyadenylation site and a highly conserved sequence of six nucleotides, AAUAAA, located 11-30 nucleotides upstream. Termination and polyadenylation signals that are suitable for some embodiments of the invention include those derived from SV40.

In addition to the elements already described, the expression vector of some embodiments of the invention may typically contain other specialized elements intended to increase the level of expression of cloned nucleic acids or to facilitate the identification of cells that carry the recombinant DNA. For example, a number of animal viruses contain DNA sequences that promote the extra chromosomal replication of the viral genome in permissive cell types. Plasmids bearing these viral replicons are replicated episomally as long as the appropriate factors are provided by genes either carried on the plasmid or with the genome of the host cell.

The vector may or may not include a eukaryotic replicon. If a eukaryotic replicon is present, then the vector is amplifiable in eukaryotic cells using the appropriate selectable marker. If the vector does not comprise a eukaryotic replicon, no episomal amplification is possible. Instead, the recombinant DNA integrates into the genome of the engineered cell, where the promoter directs expression of the desired nucleic acid.

The expression vector of some embodiments of the invention can further include additional polynucleotide sequences that allow, for example, the translation of several proteins from a single mRNA such as an internal ribosome entry site (IRES) and sequences for genomic integration of the promoter-chimeric polypeptide.

It will be appreciated that the individual elements comprised in the expression vector can be arranged in a variety of configurations. For example, enhancer elements, promoters and the like, and even the polynucleotide sequence(s) encoding a protein-of-interest can be arranged in a "head-to-tail" configuration, may be present as an inverted complement, or in a complementary configuration, as an antiparallel strand. While such variety of configuration is more likely to occur with non-coding elements of the expression vector, alternative configurations of the coding sequence within the expression vector are also envisioned.

Examples for mammalian expression vectors include, but are not limited to, pcDNA3, pcDNA3.1(+/−), pGL3, pZeoSV2(+/−), pSecTag2, pDisplay, pEF/myc/cyto, pCMV/myc/cyto, pCR3.1, pSinRep5, DH26S, DHBB, pNMT1, pNMT41, pNMT81, which are available from Invitrogen, pCI which is available from Promega, pMbac, pPbac, pBK-RSV and pBK-CMV which are available from Strategene, pTRES which is available from Clontech, and their derivatives.

Expression vectors containing regulatory elements from eukaryotic viruses such as retroviruses can be also used. SV40 vectors include pSVT7 and pMT2. Vectors derived from bovine papilloma virus include pBV-1MTHA, and vectors derived from Epstein Bar virus include pHEBO, and p2O5. Other exemplary vectors include pMSG, pAV009/A+, pMTO10/A+, pMAMneo-5, baculovirus pDSVE, and any other vector allowing expression of proteins under the direction of the SV-40 early promoter, SV-40 later promoter, metallothionein promoter, murine mammary tumor virus promoter, Rous sarcoma virus promoter, polyhedrin promoter, or other promoters shown effective for expression in eukaryotic cells.

As described above, viruses are very specialized infectious agents that have evolved, in many cases, to elude host defense mechanisms. Typically, viruses infect and propagate in specific cell types. The targeting specificity of viral vectors utilizes its natural specificity to specifically target predetermined cell types and thereby introduce a recombinant gene into the infected cell. Thus, the type of vector used by some embodiments of the invention will depend on the cell type transformed. The ability to select suitable vectors according to the cell type transformed is well within the capabilities of the ordinary skilled artisan and as such no general description of selection consideration is provided herein. For example, bone marrow cells can be targeted using the human T cell leukemia virus type I (HTLV-I) and kidney cells may be targeted using the heterologous promoter present in the baculovirus *Autographa californica* nucleopolyhedrovirus (AcMNPV) as described in Liang C Y et al., 2004 (Arch Virol. 149: 51-60).

Recombinant viral vectors are useful for in vivo expression of the protein-of-interest since they offer advantages such as lateral infection and targeting specificity. Lateral infection is inherent in the life cycle of, for example, retrovirus and is the process by which a single infected cell produces many progeny virions that bud off and infect neighboring cells. The result is that a large area becomes rapidly infected, most of which was not initially infected by the original viral particles. This is in contrast to vertical-type of infection in which the infectious agent spreads only through daughter progeny. Viral vectors can also be produced that are unable to spread laterally. This characteristic can be useful if the desired purpose is to introduce a specified gene into only a localized number of targeted cells.

Various methods can be used to introduce the expression vector of some embodiments of the invention into stem cells. Such methods are generally described in Sambrook et al., Molecular Cloning: A Laboratory Manual, Cold Springs Harbor Laboratory, New York (1989, 1992), in Ausubel et al., Current Protocols in Molecular Biology, John Wiley and Sons, Baltimore, Md. (1989), Chang et al., Somatic Gene Therapy, CRC Press, Ann Arbor, Mich. (1995), Vega et al., Gene Targeting, CRC Press, Ann Arbor Mich. (1995), Vectors: A Survey of Molecular Cloning Vectors and Their Uses, Butterworths, Boston Mass. (1988) and Gilboa et at. [Biotechniques 4 (6): 504-512, 1986] and include, for example, stable or transient transfection, lipofection, electroporation and infection with recombinant viral vectors. In addition, see U.S. Pat. Nos. 5,464,764 and 5,487,992 for positive-negative selection methods.

Introduction of nucleic acids by viral infection offers several advantages over other methods such as lipofection and electroporation, since higher transfection efficiency can be obtained due to the infectious nature of viruses.

Currently preferred in vivo nucleic acid transfer techniques include transfection with viral or non-viral constructs, such as adenovirus, lentivirus, Herpes simplex I virus, or adeno-associated virus (AAV) and lipid-based systems. Useful lipids for lipid-mediated transfer of the gene are, for example, DOTMA, DOPE, and DC-Chol [Tonkinson et al., Cancer Investigation, 14(1): 54-65 (1996)]. The most preferred constructs for use in gene therapy are viruses, most preferably adenoviruses, AAV, lentiviruses, or retroviruses. A viral construct such as a retroviral construct includes at least one transcriptional promoter/enhancer or locus-defining element(s), or other elements that control gene expression by other means such as alternate splicing, nuclear RNA export, or post-translational modification of messenger. Such vector constructs also include a packaging signal, long terminal repeats (LTRs) or portions thereof, and positive and negative strand primer binding sites appropriate to the virus used, unless it is already present in the viral construct. In addition, such a construct typically includes a signal sequence for secretion of the peptide from a host cell in which it is placed. Preferably the signal sequence for this purpose is a mammalian signal sequence or the signal sequence of the polypeptide variants of some embodiments of the invention. Optionally, the construct may also include a signal that directs polyadenylation, as well as one or more restriction sites and a translation termination sequence. By way of example, such constructs will typically include a 5' LTR, a tRNA binding site, a packaging signal, an origin of second-strand DNA synthesis, and a 3' LTR or a portion thereof. Other vectors can be used that are non-viral, such as cationic lipids, polylysine, and dendrimers.

Other than containing the necessary elements for the transcription and translation of the inserted coding sequence, the expression construct of some embodiments of the invention can also include sequences engineered to enhance stability, production, purification, yield or toxicity of the expressed peptide. For example, the expression of a fusion protein or a cleavable fusion protein comprising the polypeptide-of-interest of some embodiments of the invention and a heterologous protein can be engineered. Such a fusion protein can be designed so that the fusion protein can be readily isolated by affinity chromatography; e.g., by immobilization on a column specific for the heterologous protein. Where a cleavage site is engineered between the protein-of-interest and the heterologous protein, the protein-of-interest can be released from the chromatographic column by treatment with an appropriate enzyme or agent that disrupts the cleavage site [e.g., see Booth et al. (1988) Immunol. Lett. 19:65-70; and Gardella et al., (1990) J. Biol. Chem. 265:15854-15859].

As mentioned hereinabove, a variety of prokaryotic or eukaryotic cells can be used as host-expression systems to express the polypeptides of some embodiments of the invention. These include, but are not limited to, microorganisms, such as bacteria transformed with a recombinant bacteriophage DNA, plasmid DNA or cosmid DNA expression vector containing the coding sequence; yeast transformed with recombinant yeast expression vectors containing the coding sequence; plant cell systems infected with recombinant virus expression vectors (e.g., cauliflower mosaic virus, CaMV; tobacco mosaic virus, TMV) or transformed with recombinant plasmid expression vectors, such as Ti plasmid, containing the coding sequence. Mammalian expression systems can also be used to express the polypeptides of some embodiments of the invention.

Examples of bacterial constructs include the pET series of *E. coli* expression vectors [Studier et al. (1990) Methods in Enzymol. 185:60-89).

In yeast, a number of vectors containing constitutive or inducible promoters can be used, as disclosed in U.S. Pat. No. 5,932,447. Alternatively, vectors can be used which promote integration of foreign DNA sequences into the yeast chromosome.

In cases where plant expression vectors are used, the expression of the coding sequence can be driven by a number of promoters. For example, viral promoters such as the 35S RNA and 19S RNA promoters of CaMV [Brisson et al. (1984) Nature 310:511-514], or the coat protein promoter to TMV [Takamatsu et al. (1987) EMBO J. 6:307-311] can be used. Alternatively, plant promoters such as the small subunit of RUBISCO [Coruzzi et al. (1984) EMBO J. 3:1671-1680 and Brogli et al., (1984) Science 224:838-843] or heat shock promoters, e.g., soybean hsp17.5-E or hsp17.3-B [Gurley et al. (1986) Mol. Cell. Biol. 6:559-565] can be used. These constructs can be introduced into plant cells using Ti plasmid, Ri plasmid, plant viral vectors, direct DNA transformation, microinjection, electroporation and other techniques well known to the skilled artisan. See, for example, Weissbach & Weissbach, 1988, Methods for Plant Molecular Biology, Academic Press, NY, Section VIII, pp 421-463.

Other expression systems such as insects and mammalian host cell systems which are well known in the art and are further described hereinbelow can also be used by some embodiments of the invention.

Transformed cells are cultured under effective conditions, which allow for the expression of high amounts of the recombinant polypeptide-of-interest (e.g., the LIF, TGFβ1, bFGF, OCT4, c-myc, SOX2, KLF-4). Following a predetermined time in culture, recovery of the recombinant polypeptide is effected. The phrase "recovery of the recombinant polypeptide" used herein refers to collecting the whole fermentation medium containing the polypeptide and need not imply additional steps of separation or purification.

Thus, polypeptide-of-interest can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization.

The polypeptide-of-interest is preferably retrieved in "substantially pure" form.

As used herein, the phrase "substantially pure" refers to a purity that allows for the effective use of the polypeptide-of-interest (e.g., the LIF, TGFβ1, bFGF) in maintaining the human embryonic stem cells in an undifferentiated state while in culture.

Following is a non-limiting description of downregulation agents which can be used according to some embodiments of the invention.

As used herein, the phrase "RNA silencing" refers to a group of regulatory mechanisms [e.g. RNA interference (RNAi), transcriptional gene silencing (TGS), post-transcriptional gene silencing (PTGS), quelling, co-suppression, and translational repression] mediated by RNA molecules which result in the inhibition or "silencing" of the expression of a corresponding protein-coding gene. RNA silencing has been observed in many types of organisms, including plants, animals, and fungi.

As used herein, the term "RNA silencing agent" refers to an RNA which is capable of specifically inhibiting or "silencing" the expression of a target gene. In certain embodiments, the RNA silencing agent is capable of preventing complete processing (e.g, the full translation and/or expression) of an mRNA molecule through a post-transcriptional silencing mechanism. RNA silencing agents include noncoding RNA molecules, for example RNA duplexes comprising paired strands, as well as precursor RNAs from which such small non-coding RNAs can be generated. Exemplary RNA silencing agents include dsRNAs such as siRNAs, miRNAs and shRNAs. In one embodiment, the RNA silencing agent is capable of inducing RNA interference. In another embodiment, the RNA silencing agent is capable of mediating translational repression.

RNA interference refers to the process of sequence-specific post-transcriptional gene silencing in animals mediated by short interfering RNAs (siRNAs). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla. Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA.

The presence of long dsRNAs in cells stimulates the activity of a ribonuclease III enzyme referred to as dicer. Dicer is involved in the processing of the dsRNA into short pieces of dsRNA known as short interfering RNAs (siRNAs). Short interfering RNAs derived from dicer activity are typically about 21 to about 23 nucleotides in length and comprise about 19 base pair duplexes. The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex.

Accordingly, some embodiments of the invention contemplate use of dsRNA to downregulate protein expression from mRNA.

According to one embodiment, the dsRNA is greater than 30 bp. The use of long dsRNAs (i.e. dsRNA greater than 30 bp) has been very limited owing to the belief that these longer regions of double stranded RNA will result in the induction of the interferon and PKR response. However, the use of long dsRNAs can provide numerous advantages in that the cell can select the optimal silencing sequence alleviating the need to test numerous siRNAs; long dsRNAs will allow for silencing libraries to have less complexity than would be necessary for siRNAs; and, perhaps most importantly, long dsRNA could prevent viral escape mutations when used as therapeutics.

Various studies demonstrate that long dsRNAs can be used to silence gene expression without inducing the stress response or causing significant off-target effects—see for example [Strat et al., Nucleic Acids Research, 2006, Vol. 34, No. 13 3803-3810; Bhargava A et al. Brain Res. Protoc. 2004; 13:115-125; Diallo M., et al., Oligonucleotides. 2003; 13:381-392; Paddison P. J., et al., Proc. Natl Acad. Sci. USA. 2002; 99:1443-1448; Tran N., et al., FEBS Lett. 2004; 573:127-134].

In particular, the invention according to some embodiments thereof contemplates introduction of long dsRNA (over 30 base transcripts) for gene silencing in cells where the interferon pathway is not activated (e.g. embryonic cells and oocytes) see for example Billy et al., PNAS 2001, Vol 98, pages 14428-14433. and Diallo et al, Oligonucleotides, Oct. 1, 2003, 13(5): 381-392. doi: 10.1089/154545703322617069.

The invention according to some embodiments thereof also contemplates introduction of long dsRNA specifically designed not to induce the interferon and PKR pathways for down-regulating gene expression. For example, Shinagwa and Ishii [Genes & Dev. 17 (11): 1340-1345, 2003] have developed a vector, named pDECAP, to express long double-strand RNA from an RNA polymerase II (Pol II) promoter. Because the transcripts from pDECAP lack both the 5'-cap structure and the 3'-poly(A) tail that facilitate ds-RNA export to the cytoplasm, long ds-RNA from pDECAP does not induce the interferon response.

Another method of evading the interferon and PKR pathways in mammalian systems is by introduction of small inhibitory RNAs (siRNAs) either via transfection or endogenous expression.

The term "siRNA" refers to small inhibitory RNA duplexes (generally between 18-30 basepairs) that induce the RNA interference (RNAi) pathway. Typically, siRNAs are chemically synthesized as 21mers with a central 19 bp duplex region and symmetric 2-base 3'-overhangs on the termini, although it has been recently described that chemically synthesized RNA duplexes of 25-30 base length can have as much as a 100-fold increase in potency compared with 21mers at the same location. The observed increased potency obtained using longer RNAs in triggering RNAi is theorized to result from providing Dicer with a substrate (27mer) instead of a product (21mer) and that this improves the rate or efficiency of entry of the siRNA duplex into RISC.

It has been found that position of the 3'-overhang influences potency of an siRNA and asymmetric duplexes having a 3'-overhang on the antisense strand are generally more potent than those with the 3'-overhang on the sense strand (Rose et al., 2005). This can be attributed to asymmetrical strand loading into RISC, as the opposite efficacy patterns are observed when targeting the antisense transcript.

The strands of a double-stranded interfering RNA (e.g., an siRNA) may be connected to form a hairpin or stem-loop structure (e.g., an shRNA). Thus, as mentioned the RNA silencing agent of some embodiments of the invention may also be a short hairpin RNA (shRNA).

The term "shRNA", as used herein, refers to an RNA agent having a stem-loop structure, comprising a first and second region of complementary sequence, the degree of complementarity and orientation of the regions being sufficient such that base pairing occurs between the regions, the first and second regions being joined by a loop region, the loop resulting from a lack of base pairing between nucleotides (or nucleotide analogs) within the loop region. The number of nucleotides in the loop is a number between and including 3 to 23, or 5 to 15, or 7 to 13, or 4 to 9, or 9 to 11. Some of the nucleotides in the loop can be involved in base-pair interactions with other nucleotides in the loop. Examples of oligonucleotide sequences that can be used to form the loop include 5'-UUCAAGAGA-3' (Brummelkamp, T. R. et al. (2002) Science 296: 550) and 5'-UUUGUGUAG-3' (Castanotto, D. et al. (2002) RNA 8:1454). It will be recognized by one of skill in the art that the resulting single chain oligonucleotide forms a stem-loop or hairpin structure comprising a double-stranded region capable of interacting with the RNAi machinery.

Synthesis of RNA silencing agents suitable for use with some embodiments of the invention can be effected as follows. First, the tumor suppressor mRNA sequence is scanned downstream of the AUG start codon for AA dinucleotide sequences. Occurrence of each AA and the 3' adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tuschl Chem Biochem. 2:239-245]. It will be appreciated though, that siRNAs directed at untranslated regions may also be effective, as demonstrated for GAPDH wherein siRNA directed at the 5' UTR mediated about 90% decrease in cellular GAPDH mRNA and completely abolished protein level (ambion (dot) com/techlib/tn/91/912 (dot) html).

Second, potential target sites are compared to an appropriate genomic database (e.g., human, mouse, rat etc.) using any sequence alignment software, such as the BLAST software available from the NCBI server (ncbi (dot) nlm (dot) nih (dot) gov/BLAST/). Putative target sites which exhibit significant homology to other coding sequences are filtered out.

Qualifying target sequences are selected as template for siRNA synthesis. Preferred sequences are those including low G/C content as these have proven to be more effective in mediating gene silencing as compared to those with G/C content higher than 55%. Several target sites are preferably selected along the length of the target gene for evaluation. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to any other gene.

It will be appreciated that the RNA silencing agent of some embodiments of the invention need not be limited to those molecules containing only RNA, but further encompasses chemically-modified nucleotides and non-nucleotides.

In some embodiments, the RNA silencing agent provided herein can be functionally associated with a cell-penetrating peptide." As used herein, a "cell-penetrating peptide" is a peptide that comprises a short (about 12-30 residues) amino acid sequence or functional motif that confers the energy-independent (i.e., non-endocytotic) translocation properties associated with transport of the membrane-permeable complex across the plasma and/or nuclear membranes of a cell. The cell-penetrating peptide used in the membrane-permeable complex of some embodiments of the invention preferably comprises at least one non-functional cysteine residue, which is either free or derivatized to form a disulfide link with a double-stranded ribonucleic acid that has been modified for such linkage. Representative amino acid motifs conferring such properties are listed in U.S. Pat. No. 6,348,185, the contents of which are expressly incorporated herein by reference. The cell-penetrating peptides of some embodiments of the invention preferably include, but are not limited to, penetratin, transportan, pIsl, TAT(48-60), pVEC, MTS, and MAP.

According to another embodiment the RNA silencing agent may be a miRNA.

The term "microRNA", "miRNA", and "miR" are synonymous and refer to a collection of non-coding single-stranded RNA molecules of about 19-28 nucleotides in length, which regulate gene expression. miRNAs are found in a wide range of organisms (viruses.fwdarw.humans) and have been shown to play a role in development, homeostasis, and disease etiology.

Below is a brief description of the mechanism of miRNA activity.

Genes coding for miRNAs are transcribed leading to production of an miRNA precursor known as the pri-miRNA. The pri-miRNA is typically part of a polycistronic RNA comprising multiple pri-miRNAs. The pri-miRNA may form a hairpin with a stem and loop. The stem may comprise mismatched bases.

The hairpin structure of the pri-miRNA is recognized by Drosha, which is an RNase III endonuclease. Drosha typically recognizes terminal loops in the pri-miRNA and cleaves approximately two helical turns into the stem to produce a 60-70 nucleotide precursor known as the pre-miRNA. Drosha cleaves the pri-miRNA with a staggered cut typical of RNase III endonucleases yielding a pre-miRNA stem loop with a 5' phosphate and ~2 nucleotide 3' overhang. It is estimated that approximately one helical turn of stem (~10 nucleotides) extending beyond the Drosha cleavage site is essential for efficient processing. The pre-miRNA is then actively transported from the nucleus to the cytoplasm by Ran-GTP and the export receptor Ex-portin-5.

The double-stranded stem of the pre-miRNA is then recognized by Dicer, which is also an RNase III endonuclease. Dicer may also recognize the 5' phosphate and 3' overhang at the base of the stem loop. Dicer then cleaves off the terminal loop two helical turns away from the base of the stem loop leaving an additional 5' phosphate and ~2 nucleotide 3' overhang. The resulting siRNA-like duplex, which may comprise mismatches, comprises the mature miRNA and a similar-sized fragment known as the miRNA*. The miRNA and miRNA* may be derived from opposing arms of the pri-miRNA and pre-miRNA. MiRNA* sequences may be found in libraries of cloned miRNAs but typically at lower frequency than the miRNAs.

Although initially present as a double-stranded species with miRNA*, the miRNA eventually become incorporated as a single-stranded RNA into a ribonucleoprotein complex known as the RNA-induced silencing complex (RISC). Various proteins can form the RISC, which can lead to variability in specificity for miRNA/miRNA* duplexes, binding site of the target gene, activity of miRNA (repress or activate), and which strand of the miRNA/miRNA* duplex is loaded in to the RISC.

When the miRNA strand of the miRNA:miRNA* duplex is loaded into the RISC, the miRNA* is removed and degraded. The strand of the miRNA:miRNA* duplex that is loaded into the RISC is the strand whose 5' end is less tightly paired. In cases where both ends of the miRNA:miRNA* have roughly equivalent 5' pairing, both miRNA and miRNA* may have gene silencing activity.

The RISC identifies target nucleic acids based on high levels of complementarity between the miRNA and the mRNA, especially by nucleotides 2-7 of the miRNA.

A number of studies have looked at the base-pairing requirement between miRNA and its mRNA target for achieving efficient inhibition of translation (reviewed by Bartel 2004, Cell 116-281). In mammalian cells, the first 8 nucleotides of the miRNA may be important (Doench & Sharp 2004 Genes Dev 2004-504). However, other parts of the microRNA may also participate in mRNA binding. Moreover, sufficient base pairing at the 3' can compensate for insufficient pairing at the 5' (Brennecke et al, 2005 PLoS 3-e85). Computation studies, analyzing miRNA binding on whole genomes have suggested a specific role for bases 2-7 at the 5' of the miRNA in target binding but the role of the first nucleotide, found usually to be "A" was also recognized (Lewis et at 2005 Cell 120-15). Similarly, nucleotides 1-7 or 2-8 were used to identify and validate targets by Krek et al (2005, Nat Genet 37-495).

The target sites in the mRNA may be in the 5' UTR, the 3' UTR or in the coding region. Interestingly, multiple miRNAs may regulate the same mRNA target by recognizing the same or multiple sites. The presence of multiple miRNA binding sites in most genetically identified targets may indicate that the cooperative action of multiple RISCs provides the most efficient translational inhibition.

MiRNAs may direct the RISC to downregulate gene expression by either of two mechanisms: mRNA cleavage or translational repression. The miRNA may specify cleavage of the mRNA if the mRNA has a certain degree of complementarity to the miRNA. When a miRNA guides cleavage, the cut is typically between the nucleotides pairing to residues 10 and 11 of the miRNA. Alternatively, the miRNA may repress translation if the miRNA does not have the requisite degree of complementarity to the miRNA. Translational repression may be more prevalent in animals since animals may have a lower degree of complementarity between the miRNA and binding site.

It should be noted that there may be variability in the 5' and 3' ends of any pair of miRNA and miRNA*. This variability may be due to variability in the enzymatic processing of Drosha and Dicer with respect to the site of cleavage. Variability at the 5' and 3' ends of miRNA and miRNA* may also be due to mismatches in the stem structures of the pri-miRNA and pre-miRNA. The mismatches of the stem strands may lead to a population of different hairpin structures. Variability in the stem structures may also lead to variability in the products of cleavage by Drosha and Dicer.

The term "microRNA mimic" refers to synthetic non-coding RNAs that are capable of entering the RNAi pathway and regulating gene expression. miRNA mimics imitate the function of endogenous microRNAs (miRNAs) and can be designed as mature, double stranded molecules or mimic precursors (e.g., or pre-miRNAs). miRNA mimics can be comprised of modified or unmodified RNA, DNA, RNA-DNA hybrids, or alternative nucleic acid chemistries (e.g., LNAs or 2'-O,4'-C-ethylene-bridged nucleic acids (ENA)). For mature, double stranded miRNA mimics, the length of the duplex region can vary between 13-33, 18-24 or 21-23 nucleotides. The miRNA may also comprise a total of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 nucleotides. The sequence of the miRNA may be the first 13-33 nucleotides of the pre-miRNA. The sequence of the miRNA may also be the last 13-33 nucleotides of the pre-miRNA.

It will be appreciated from the description provided herein above, that contacting pluripotent stem cells with a miRNA may be affected in a number of ways:

1. Transiently transfecting the pluripotent stem cells with the mature double stranded miRNA;
2. Stably, or transiently transfecting the pluripotent stem cells with an expression vector which encodes the mature miRNA.
3. Stably, or transiently transfecting the pluripotent stem cells with an expression vector which encodes the pre-miRNA. The pre-miRNA sequence may comprise from 45-90, 60-80 or 60-70 nucleotides. The sequence of the pre-miRNA may comprise a miRNA and a miRNA* as set forth herein. The sequence of the pre-miRNA may also be that of a pri-miRNA excluding from 0-160 nucleotides from the 5' and 3' ends of the pri-miRNA.
4. Stably, or transiently transfecting the pluripotent stem cells with an expression vector which encodes the pri-miRNA The pri-miRNA sequence may comprise from 45-30,000, 50-25,000, 100-20,000, 1,000-1,500 or 80-100 nucleotides. The sequence of the pri-miRNA may comprise a pre-miRNA, miRNA and miRNA*, as set forth herein, and variants thereof.

Preparation of miRNAs mimics can be effected by chemical synthesis methods or by recombinant methods.

Another agent capable of downregulating the tumor suppressor protein of some embodiments of the invention (e.g., P53 and/or NF-kappa-B inhibitor alpha) is a DNAzyme molecule capable of specifically cleaving an mRNA transcript or DNA sequence of the tumor suppressor protein. DNAzymes are single-stranded polynucleotides which are capable of cleaving both single and double stranded target sequences (Breaker, R. R. and Joyce, G. Chemistry and Biology 1995; 2:655; Santoro, S. W. & Joyce, G. F. Proc. Natl, Acad. Sci. USA 1997; 943:4262) A general model (the "10-23" model) for the DNAzyme has been proposed. "10-23" DNAzymes have a catalytic domain of 15 deoxyribonucleotides, flanked by two substrate-recognition domains of seven to nine deoxyribonucleotides each. This type of DNAzyme can effectively cleave its substrate RNA at purine:pyrimidine junctions (Santoro, S. W. & Joyce, G. F. Proc. Natl, Acad. Sci. USA 199; for rev of DNAzymes see Khachigian, L M [Curr Opin Mol Ther 4:119-21 (2002)].

Examples of construction and amplification of synthetic, engineered DNAzymes recognizing single and double-stranded target cleavage sites have been disclosed in U.S. Pat. No. 6,326,174 to Joyce et al. DNAzymes of similar design directed against the human Urokinase receptor were recently observed to inhibit Urokinase receptor expression, and successfully inhibit colon cancer cell metastasis in vivo (Itoh et al, 2002, Abstract 409, Ann Meeting Am Soc Gen Ther www(dot)asgt(dot)org). In another application, DNAzymes complementary to bcr-ab1 oncogenes were successful in inhibiting the oncogenes expression in leukemia cells, and lessening relapse rates in autologous bone marrow transplant in cases of CML and ALL.

Downregulation of the tumor suppressor gene of some embodiments of the invention (e.g., P53 and/or NF-kappa-B inhibitor alpha) can also be effected by using an antisense polynucleotide capable of specifically hybridizing with an mRNA transcript encoding the tumor suppressor protein.

Design of antisense molecules which can be used to efficiently downregulate a tumor suppressor protein must be effected while considering two aspects important to the antisense approach. The first aspect is delivery of the oligonucleotide into the cytoplasm of the appropriate cells, while the second aspect is design of an oligonucleotide which specifically binds the designated mRNA within cells in a way which inhibits translation thereof.

The prior art teaches of a number of delivery strategies which can be used to efficiently deliver oligonucleotides into a wide variety of cell types [see, for example, Luft J Mol Med 76: 75-6 (1998); Kronenwett et al. Blood 91: 852-62 (1998); Rajur et al. Bioconjug Chem 8: 935-40 (1997); Lavigne et al. Biochem Biophys Res Commun 237: 566-71 (1997) and Aoki et al. (1997) Biochem Biophys Res Commun 231: 540-5 (1997)].

In addition, algorithms for identifying those sequences with the highest predicted binding affinity for their target mRNA based on a thermodynamic cycle that accounts for the energetics of structural alterations in both the target mRNA and the oligonucleotide are also available [see, for example, Walton et al. Biotechnol Bioeng 65: 1-9 (1999)].

Such algorithms have been successfully used to implement an antisense approach in cells. For example, the algorithm developed by Walton et al. enabled scientists to successfully design antisense oligonucleotides for rabbit beta-globin (RBG) and mouse tumor necrosis factor-alpha (TNF alpha) transcripts. The same research group has more recently reported that the antisense activity of rationally selected oligonucleotides against three model target mRNAs (human lactate dehydrogenase A and B and rat gp130) in cell culture as evaluated by a kinetic PCR technique proved effective in almost all cases, including tests against three different targets in two cell types with phosphodiester and phosphorothioate oligonucleotide chemistries.

In addition, several approaches for designing and predicting efficiency of specific oligonucleotides using an in vitro system were also published (Matveeva et al., Nature Biotechnology 16: 1374-1375 (1998)].

Several clinical trials have demonstrated safety, feasibility and activity of antisense oligonucleotides. For example, antisense oligonucleotides suitable for the treatment of cancer have been successfully used [Holmund et al., Curr Opin Mol Ther 1:372-85 (1999)], while treatment of hematological malignancies via antisense oligonucleotides targeting c-myb gene, p53 and Bcl-2 had entered clinical trials and had been shown to be tolerated by patients [Gerwitz Curr Opin Mol Ther 1:297-306 (1999)].

More recently, antisense-mediated suppression of human heparanase gene expression has been reported to inhibit pleural dissemination of human cancer cells in a mouse model [Uno et al., Cancer Res 61:7855-60 (2001)].

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Another agent capable of downregulating the tumor suppressor protein of some embodiments of the invention (e.g., P53 and/or NF-kappa-B inhibitor alpha) is a ribozyme molecule capable of specifically cleaving an mRNA transcript encoding the tumore suppressor protein. Ribozymes are being increasingly used for the sequence-specific inhibition of gene expression by the cleavage of mRNAs encoding proteins of interest [Welch et al., Curr Opin Biotechnol. 9:486-96 (1998)]. The possibility of designing ribozymes to cleave any specific target RNA has rendered them valuable tools in both basic research and therapeutic applications. In the therapeutics area, ribozymes have been exploited to target viral RNAs in infectious diseases, dominant oncogenes in cancers and specific somatic mutations in genetic disorders [Welch et al., Clin Diagn Virol. 10:163-71 (1998)]. Most notably, several ribozyme gene therapy protocols for HIV patients are already in Phase 1 trials. More recently, ribozymes have been used for transgenic animal research, gene target validation and pathway elucidation. Several ribozymes are in various stages of clinical trials. ANGIOZYME was the first chemically synthesized ribozyme to be studied in human clinical trials. ANGIOZYME specifically inhibits formation of the VEGF-r (Vascular Endothelial Growth Factor receptor), a key component in the angiogenesis pathway. Ribozyme Pharmaceuticals, Inc., as well as other firms have demonstrated the importance of anti-angiogenesis therapeutics in animal models. HEPTAZYME, a ribozyme designed to selectively destroy Hepatitis C Virus (HCV) RNA, was found effective in decreasing Hepatitis C viral RNA in cell culture assays (Ribozyme Pharmaceuticals, Incorporated—WEB home page).

An additional method of regulating the expression of the tumor suppressor protein of some embodiments of the invention (e.g., P53 and/or NF-kappa-B inhibitor alpha) in cells is via triplex forming oligonucleotides (TFOs). Recent studies have shown that TFOs can be designed which can recognize and bind to polypurine/polypirimidine regions in double-stranded helical DNA in a sequence-specific manner. These recognition rules are outlined by Maher III, L. J., et al., Science, 1989; 245:725-730; Moser, H. E., et al., Science, 1987; 238:645-630; Beal, P. A., et al, Science, 1992; 251:1360-1363; Cooney, M., et al., Science, 1988; 241:456-459; and Hogan, M. E., et al., EP Publication 375408. Modification of the oligonucleotides, such as the introduction of intercalators and backbone substitutions, and optimization of binding conditions (pH and cation concentration) have aided in overcoming inherent obstacles to TFO activity such as charge repulsion and instability, and it was recently shown that synthetic oligonucleotides can be targeted to specific sequences (for a recent review see Seidman and Glazer, J Clin Invest 2003; 112:487-94).

In general, the triplex-forming oligonucleotide has the sequence correspondence:

| oligo  | 3'--A | G | G | T |
|--------|-------|---|---|---|
| duplex | 5'--A | G | C | T |
| duplex | 3'--T | C | G | A |

However, it has been shown that the A-AT and G-GC triplets have the greatest triple helical stability (Reither and Jeltsch, BMC Biochem, 2002 Sep. 12, Epub). The same authors have demonstrated that TFOs designed according to the A-AT and G-GC rule do not form non-specific triplexes, indicating that the triplex formation is indeed sequence specific.

Thus for any given sequence in the tumor suppressor gene regulatory region a triplex forming sequence may be devised. Triplex-forming oligonucleotides preferably are at least 15, more preferably 25, still more preferably 30 or more nucleotides in length, up to 50 or 100 bp.

Transfection of cells (for example, via cationic liposomes) with TFOs, and formation of the triple helical structure with the target DNA induces steric and functional changes, blocking transcription initiation and elongation, allowing the introduction of desired sequence changes in the endogenous DNA and resulting in the specific downregulation of gene expression. Examples of such suppression of gene expression in cells treated with TFOs include knockout of episomal supFG1 and endogenous HPRT genes in mammalian cells (Vasquez et al., Nucl Acids Res. 1999; 27:1176-81, and Purl, et al, J Biol Chem, 2001; 276:28991-98), and the sequence- and target specific downregulation of expression of the Ets2 transcription factor, important in prostate cancer etiology (Carbone, et al, Nucl Acid Res. 2003; 31:833-43), and the pro-inflammatory ICAM-1 gene (Besch et al, J Biol Chem, 2002; 277:32473-79). In addition, Vuyisich and Beal have recently shown that sequence specific TFOs can bind to dsRNA, inhibiting activity of dsRNA-dependent enzymes such as RNA-dependent kinases (Vuyisich and Beal, Nuc. Acids Res 2000; 28:2369-74).

Additionally, TFOs designed according to the abovementioned principles can induce directed mutagenesis capable of effecting DNA repair, thus providing both downregulation and upregulation of expression of endogenous genes (Seidman and Glazer, J Clin Invest 2003; 112:487-94). Detailed description of the design, synthesis and administration of effective TFOs can be found in U.S. Patent Application Nos. 2003 017068 and 2003 0096980 to Froehler et al, and 2002 0128218 and 2002 0123476 to Emanuele et al, and U.S. Pat. No. 5,721,138 to Lawn.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Maryland (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y. (1994), Third Edition; "Current Protocols in Immunology" Volumes I-III Coligan J. E., ed. (1994); Stites et al. (eds), "Basic and Clinical Immunology" ($8^{th}$ Edition), Appleton & Lange, Norwalk, CT (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, CA (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Materials and Methods
Base Medium
1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml of 200 mM solution (at a 2 mM final concentration)(Biological Industries—02-022-1B), Non-Essential Amino Acid (NEAA)—5 ml (Biological Industries 01-340-1B), 50 µl of 50 mM stock Beta-mercaptoethanol (1 vile), 5 ml B27 supplement (Invitrogen 17504-044), Insulin (Sigma I-1882; 12.5-25 µg/ml final concentration), Apo-transferrin (Sigma T-1147; 100 µg/ml final concentration), Progesterone (Sigma P8783) 0.02 µg/ml final concentration, Putrescine (SigmaP5780; 16 µg/ml final concentration, Sodium selenite (Sigma S5261; at a final concentration of 3 nM), L-ascorbic acid 2-phosphate (Sigma A8960; 50 µg/ml final concentration), bovine serum albumin (BSA) (100× Fraction V 7.5% Solution Gibco 15260-037. It is noted that the Insulin, Apo-transferrin, Progesterone, Putrescine and Sodium selenite are components of the N2 mix.

Supplements
Culture Medium 1:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), AXINs (IWR1, 2 µM) and SRCi (CGP77675, 1.5 µM).
Culture Medium 2:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), AXINs (IWR1, 2 µM), SRCi (CGP77675, 1.5 µM), BMPi (LDN-193189 0.2 µM).
Culture Medium 3:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), AXINs (IWR1, 2 µM), SRCi (CGP77675, 1.5 µM) and PKCi (Go6983 0.5 µM).
Culture Medium 4:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), AXINs (IWR1, 2 µM), SRCi (CGP77675, 1.5 µM), BMPi (LDN-193189 0.2 µM) and PKCi (Go6983 0.5 µM).
Culture Medium 5:
LIF (20 ng/ml), ERK1/2i (PD0325901, 1 µM), GSK3βi (CHIR99021, 3 µM), P38i (BIRB796, 2 µM), FGF2 (8 ng/ml), TGFβ1 (2 ng/ml), ROCKi (Y27632 10 µM), AXINs (IWR1, 2 µM), SRCi (CGP77675, 1.5 µM).
Culture Medium 6:
LIF (20 ng/ml), ERK1/2i (PD0325901, 1 µM), GSK3βi (CHIR99021, 3 µM), P38i (BIRB796, 2 µM), FGF2 (8 ng/ml), TGFβ1 (2 ng/ml), ROCKi (Y27632 10 µM), AXINs (IWR1, 2 µM), SRCi (CGP77675, 1.5 µM), BMPi (LDN-193189 0.2 µM).
Culture Medium 7:
LIF (20 ng/ml), ERK1/2i (PD0325901, 1 µM), GSK3βi (CHIR99021, 3 µM), P38i (BIRB796, 2 µM), FGF2 (8 ng/ml), TGFβ1 (2 ng/ml), ROCKi (Y27632 10 µM), AXINs (IWR1, 2 µM), SRCi (CGP77675, 1.5 µM) and PKCi (Go6983 0.5 µM).
Culture Medium 8:
LIF (20 ng/ml), ERK1/2i (PD0325901, 1 µM), GSK3βi (CHIR99021, 3 µM), P38i (BIRB796, 2 µM), FGF2 (8 ng/ml), TGFβ1 (2 ng/ml), ROCKi (Y27632 10 µM), AXINs (IWR1, 2 µM), SRCi (CGP77675, 1.5 µM), BMPi (LDN-193189 0.2 µM) and PKCi (Go6983 0.5 µM).
Culture Medium 9:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), SRCi (CGP77675, 1.5 µM).
Culture Medium 10:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), SRCi (CGP77675, 1.5 µM), BMPi (LDN-193189 0.2 µM).
Culture Medium 11:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), SRCi (CGP77675, 1.5 µM) and PKCi (Go6983 0.5 µM).

Culture Medium 12:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), SRCi (CGP77675, 1.5 µM), BMPi (LDN-193189 0.2 µM) and PKCi (Go6983 0.5 µM).

Culture Medium 13:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), SRCi (CGP77675, 1.5 µM).

Culture Medium 14:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), SRCi (CGP77675, 1.5 µM), BMPi (LDN-193189 0.2 µM).

Culture Medium 15:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), SRCi (CGP77675, 1.5 µM) and PKCi (Go6983 0.5 µM).

Culture Medium 16:
LIF (20 ng/ml), ERK1/2i (PD0325901, 1 µM), GSK3βi (CHIR99021, 3 µM), P38i (BIRB796, 2 µM), JNKi (SP600125, 5 µM), FGF2 (8 ng/ml), TGFβ1 (2 ng/ml), ROCKi (Y27632 10 µM), SRCi (CGP77675, 1.5 µM), BMPi (LDN-193189 0.2 µM) and PKCi (Go6983 0.5 µM).

Culture Medium 17:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), SRCi (CGP77675, 1.5 µM).

Culture Medium 18:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), SRCi (CGP77675, 1.5 µM), BMPi (LDN-193189 0.2 µM).

Culture Medium 19:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), SRCi (CGP77675, 1.5 µM) and PKCi (Go6983 0.5 µM).

Culture Medium 20:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), SRCi (CGP77675, 1.5 µM), BMPi (LDN-193189 0.2 µM) and PKCi (Go6983 0.5 µM).

Culture Medium 21:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM).

Culture Medium 22:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM), BMPi (LDN-193189 0.2 µM).

Culture Medium 23:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM) and PKCi (Go6983 0.5 µM).

Culture Medium 24:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM), BMPi (LDN-193189 0.2 µM) and PKCi (Go6983 0.5 µM).

Culture Medium 25:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM).

Culture Medium 26:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), BMPi (LDN-193189 0.2 µM).

Culture Medium 27:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM) and PKCi (Go6983 0.5 µM).

Culture Medium 28:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), BMPi (LDN-193189 0.2 µM) and PKCi (Go6983 0.5 µM).

Culture Medium 29:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM), FGFRi (PD173074 0.1 µM).

Culture Medium 30:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM), FGFRi (PD173074 0.1 µM), BMPi (LDN-193189 0.2 µM).

Culture Medium 31:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), SRCi (CGP77675, 1.5 µM), FGFRi (PD173074 0.1 µM) and PKCi (Go6983 0.5 µM).

Culture Medium 32:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), SRCi (CGP77675, 1.5 µM), FGFRi (PD173074 0.1 µM), BMPi (LDN-193189 0.2 µM) and PKCi (Go6983 0.5 µM).

Culture Medium 33:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), FGFRi (PD173074 0.1 µM).

Culture Medium 34:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), FGFRi (PD173074 0.1 µM), BMPi (LDN-193189 0.2 µM).

Culture Medium 35:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), FGFRi (PD173074 0.1 µM) and PKCi (Go6983 0.5 µM).

Culture Medium 36:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), FGFRi (PD173074 0.1 µM), BMPi (LDN-193189 0.2 µM) and PKCi (Go6983 0.5 µM).

Culture Medium 37:
LIF (20 ng/ml), ERK1/2i (PD0325901, 1 µM), GSK3βi (CHIR99021, 3 µM), P38i (BIRB796, 2 µM), JNKi (SP600125, 5 µM), TGFβ1 (2 ng/ml), ROCKi (Y27632 10 µM), AXINs (IWR1, 2 µM), SRCi (CGP77675, 1.5 µM), TGFRi (SB431542 2 µM).

Culture Medium 38:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM), TGFRi (SB431542 2 µM), BMPi (LDN-193189 0.2 µM).

Culture Medium 39:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM), TGFRi (SB431542 2 µM) and PKCi (Go6983 0.5 µM).

Culture Medium 40:
LIF (20 ng/ml), ERK1/2i (PD0325901, 1 µM), GSK3βi (CHIR99021, 3 µM), P38i (BIRB796, 2 µM), JNKi (SP600125, 5 µM), ROCKi (Y27632 10 µM), AXINs (IWR1, 2 µM), SRCi (CGP77675, 1.5 µM), TGFRi (SB431542 2 µM), BMPi (LDN-193189 0.2 µM) and PKCi (Go6983 0.5 µM).

Cells:
WIBR3 hESC line carrying Oct4-GFP reporter (described in Gafni et al. Nature 2013 Dec. 12; 504(7479):282-6. doi: 10.1038/nature12745. Epub 2013 Oct. 30).

WIBR3 hESC line carrying deltaPEOct4-GFP reporter (described in Gafni et al. Nature 2013 Dec. 12; 504(7479): 282-6. doi: 10.1038/nature12745. Epub 2013 Oct. 30).

The cells were expanded for up to 21 passages on Gelatin/DR4 coated plates in 5% O$_2$.

Analysis:
The cells were evaluated by FACS analysis for OCT4-GFP+ reporter or deltaPEOct4-GFP reporter.

Results
FIG. 1 is a graph illustrating FACS analysis of WIBR3 hESC line carrying Oct4-GFP reporter. The results show the cells maintain their pluripotency in the conditions described.

FIG. 2 is a graph illustrating FACS analysis of WIBR3 hESC line carrying deltaPEOct4-GFP reporter. The results show the cells maintain their pluripotency in the conditions described.

Example 2

Materials and Methods
Base Medium
1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 µL of 50 mM stock Beta-mercaptoethanol (1 vile), 5 ml B27 supplement (Invitrogen 17504-044), Insulin (Sigma I-1882)—12.5 microg/ml insulin), Apo-transferrin (Sigma T-1147), 100 µg/ml final concentration, Progesterone (Sigma P8783), 0.02 µg/ml final concentration, Putrescine (SigmaP5780), 16 µg/ml final concentration, Sodium selenite (Sigma S5261), add 5 µl of 3 mM stock solution per 500 ml of medium, L-ascorbic acid 2-phosphate (Sigma A8960) (50 µg/ml final concentration), BSA (100× Fraction V 7.5% Solution Gibco 15260-037.

Supplements
As in Example 1.

Cells:
WIS2 hESC line
The cells were expanded for 12 passages and 20 passages on vitronectin coated plates in 5% O$_2$.

Analysis:
The cells were evaluated by microscopically.

Results
FIGS. 3A-F are representative images of pluripotent cell colonies at P12 in the selected conditions shown. FIG. 3A—conditions 1; FIG. 3B—conditions 2; FIG. 3C—conditions 3; FIG. 3D—conditions 4; FIG. 3E—conditions 9; FIG. 3F—conditions 11.

FIGS. 4A-D are representative images of pluripotent cell colonies at P20 in the selected conditions shown. FIG. 4A—conditions 9; FIG. 4B—conditions 10;
FIG. 4C—conditions 11; FIG. 4D—conditions 4.

Example 3

Materials and Methods
Base Medium
1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), L-glutamine 5 ml (Biological Industries—02-022-1B), NEAA—5 ml (Biological Industries 01-340-1B), 50 µL of 50 mM stock Beta-mercaptoethanol (1 vile), 5 ml B27 supplement (Invitrogen 17504-044), Insulin (Sigma I-1882)—12.5 microg/ml insulin), Apo-transferrin (Sigma T-1147), 100 µg/ml final concentration, Progesterone (Sigma P8783), 0.02 µg/ml final concentration, Putrescine (SigmaP5780), 16 µg/ml final concentration, Sodium selenite (Sigma S5261), add 5 µl of 3 mM stock solution per 500 ml of medium, L-ascorbic acid 2-phosphate (Sigma A8960) (50 µg/ml final concentration), BSA (100× Fraction V 7.5% Solution Gibco 15260-037-0.16 ml per 500 ml media bottle.

Supplements
As in Example 1.

Cells:
WIS2 hESC line
The cells were expanded for 18-20 passages on Gelatin/DR4 coated plates in 5% O$_2$.

Analysis:
The cells were stained for alkaline phosphatase stem cell marker (AP) and evaluated microscopically.

Results
FIGS. 5A-C are representative images of pluripotent cell colonies at P18-20 in the selected conditions shown. FIG. 5A—conditions 9; FIG. 5B—conditions 10; FIG. 5C—conditions 4.

Example 4

Materials and Methods
Base Medium
1:1 mix of Neurobasal Medium (Invitrogen 21103-049) and DMEM/F12 (Biological Industries 06-1170-50-1A)—total 475 ml, Pen-strep 5 ml (Biological Industries 03-033-1B), NEAA—5 ml (Biological Industries 01-340-1B), 50 µL of 50 mM stock Beta-mercaptoethanol (1 vile), 5 ml B27 supplement (Invitrogen 17504-044), Insulin (Sigma I-1882)—12.5 microg/ml insulin), Apo-transferrin (Sigma T-1147), 100 μg/ml final concentration, Progesterone (Sigma P8783), 0.02 μg/ml final concentration, Putrescine (SigmaP5780), 16 μg/ml final concentration, Sodium selenite (Sigma S5261), add 5 μl of 3 mM stock solution per 500 ml of medium., L-ascorbic acid 2-phosphate (Sigma A8960) (50 μg/ml final concentration), BSA (100× Fraction V 7.5% Solution Gibco 15260-037-0.16 ml per 500 ml media bottle.

Supplements

As in Example 1.

Cells:

FX71 human iPSC line was expanded on Gelatin/DR4 feeder cell coated plates in 5% O$_2$.

Analysis:

The cells were stained for alkaline phosphatase stem cell marker (AP) and evaluated microscopically.

Results

FIGS. 6A-F are images of human naïve ESCs/iPSCs which were expanded under particular conditions without L-glutamine. FIG. 6A—conditions 1; FIG. 6B—conditions 2; FIG. 6C—conditions 3; FIG. 6D—conditions 4; FIG. 6E—conditions 9; FIG. 6F—conditions 11. Representative images of cells in the different WIS-NHSM conditions are shown, indicating expansion of colonies without exogenous L-glutamine supplementation in these conditions.

Example 5

Materials and Methods

Base Medium

1:1 mix of Neurobasal Medium (Invitrogen 21103-049) and DMEM/F12 (Biological Industries 06-1170-50-1A)—total 475 ml. Alternatively, 475 ml of the DMEM/F12 (Biological Industries 06-1170-50-1A without HEPES). The medium was supplemented with: Pen-strep 5 ml (Biological Industries 03-033-1B), L-glutamine 5 ml of 200 mM solution (at a 2 mM final concentration) (Biological Industries—02-022-1B), Non-Essential Amino Acid (NEAA; Biological Industries 01-340-1B)—5 ml of the X100 solution into a total of 500 ml medium [Composition of the X100 solution: L-Alanine 0.89 gram/liter; L-Asparagine·H2O 1.50 gram/liter; L-Aspartic Acid 1.33 gram/liter; L-Glutamic Acid 1.47 gram/liter; Glycine 0.75 gram/liter; L-Proline 1.15 gram/liter; and L-Serine 1.05 gram/liter], 50 μl of 50 mM stock Beta-mercaptoethanol (1 vile), 10 ml B27 supplement (Invitrogen 17504-044) or Xeno-free B27 (Invitrogen A14867-01), Insulin (Sigma I-1882; 12.5 μg/ml final concentration), Apo-transferrin (Sigma T-1147; 100 μg/ml final concentration), Progesterone (Sigma P8783, 0.02 μg/ml final concentration), Putrescine (Sigma P5780; 16 μg/ml final concentration), Sodium selenite (Sigma S5261; 5 μl of 3 mM stock solution per 500 ml medium, resulting in a final concentration of 3 nM), human serum albumin (10% solution from Biological Industries 05-720-1B, add 2 ml per 500 ml media bottle, resulting in a final concentration of 0.4% Human Serum Albumin) or bovine serum albumin (BSA) (100× Fraction V 7.5% Solution Gibco 15260-037, add 0.16 ml per 500 ml media bottle, resulting in a final concentration of 0.0024% BSA).

It is noted that the base medium according to some embodiments of the invention does not include ascorbic acid, and that ascorbic acid can be supplemented in some media as shown below.

FIG. 7 schematically illustrates the composition of the medium of some embodiments of the invention.

FIGS. 8-12 provide non-limiting examples of culture media supplements (conditions 41-131) which are added to the base medium described hereinabove (in Example 5), as follows:

Supplements

Medium 41:

LIF (20 ng/ml), ERK1/2i (PD0325901, 1 μM), AXINs (IWR1, 5 μM), and PKCi (Go6983 2 μM).

Medium 42:

LIF (20 ng/ml), ERK1/2i (PD0325901, 1 μM), AXINs (IWR1, 5 μM), PKCi (Go6983 2 μM), and L-ascorbic acid (50 μg/ml).

Medium 43:

LIF (20 ng/ml), ERK1/2i (PD0325901, 1 μM), AXINs (IWR1, 5 μM), PKCi (Go6983 2 μM), and GSK3βi (CHIR99021, 1.5 μM).

Medium 44:

LIF (20 ng/ml), ERK1/2i (PD0325901, 1 μM), AXINs (IWR1, 5 μM), PKCi (Go6983 2 μM), GSK3βi (CHIR99021, 1.5 μM), and L-ascorbic acid (50 μg/ml).

Medium 45:

LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), and ROCKi (Y27632 2 μM).

Medium 46:

LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632 2 μM), and SRCi (CGP77675, 1.5 μM).

Medium 47:

LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), and P38i (BIRB796, 1 μM).

Medium 48:

LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632 2 μM), and P38i (BIRB796, 1 μM).

Medium 49:

LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), and SRCi (CGP77675, 1.5 μM).

Medium 50:

LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632 2 μM), and RAFi (SB590885, 0.5 μM).

Medium 51:

LIF (20 ng/ml), ERK1/2i (PD0325901, 1 μM), AXINs (IWR1, 2.5 μM), PKCi (Go6983 2 μM), GSK3βi (CHIR99021, 1.5 μM), L-ascorbic acid (50 μg/ml), and RAFi (SB590885, 0.5 μM).

Medium 52:

LIF (20 ng/ml), ERK1/2i (PD0325901, 1 μM), AXINs (IWR1, 2.5 μM), PKCi (Go6983 2 μM), GSK3βi (CHIR99021, 1.5 μM), L-ascorbic acid (50 μg/ml), ROCKi (Y27632 2 μM), and P38i (BIRB796, 0.1 μM).

Medium 53:

LIF (20 ng/ml), ERK1/2i (PD0325901, 1 μM), AXINs (IWR1, 2.5 μM), PKCi (Go6983 2 μM), GSK3βi (CHIR99021, 1.5 μM), L-ascorbic acid (50 μg/ml), SRCi (CGP77675, 1.5 μM), and RAFi (SB590885, 0.5 μM).

Medium 54:
LIF (20 ng/ml), ERK1/2i (PD0325901, 1 μM), AXINs (IWR1, 2.5 μM), PKCi (Go6983 2 μM), GSK3βi (CHIR99021, 1.5 μM), L-ascorbic acid (50 μg/ml), ROCKi (Y27632 2 μM), RAFi (SB590885, 0.5 μM), and SRCi (CGP77675, 1.5 μM).

Medium 55:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), RAFi-SB590885, 0.5 μM, and P38i (BIRB796, 0.1 μM).

Medium 56:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632 2 μM), P38i (BIRB796, 0.1 μM), and SRCi (CGP77675, 1.5 μM).

Medium 57:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), SRCi (CGP77675, 1.5 μM), RAFi (SB590885, 0.5 μM), and BMPi (LDN-193189, 0.2 μM).

Medium 58:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632 2 μM), RAFi (SB590885, 0.5 μM), SRCi (CGP77675, 1.5 μM), and BMPi (LDN-193189 0.2 μM).

Medium 59:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), RAFi (SB590885, 0.5 μM), P38i (BIRB796, 0.1 μM), and BMPi (LDN-193189 0.2 μM).

Medium 60:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632 2 μM), P38i (BIRB796, 0.1 μM), SRCi (CGP77675, 1.5 μM), and BMPi (LDN-193189 0.2 μM).

Medium 61:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), SRCi (CGP77675, 1.5 μM), and BMP4 (5 ng/ml).

Medium 62:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632, 2 μM), RAFi (SB590885, 0.5 μM), SRCi (CGP77675, 1.5 μM), and BMP4 (5 ng/ml).

Medium 63:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), RAFi (SB590885, 0.5 μM), P38i (BIRB796, 0.1 μM), and BMP4 (5 ng/ml).

Medium 64:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), P38i (BIRB796, 0.1 μM), SRCi (CGP77675, 1.5 μM), and BMP4 (5 ng/ml).

Medium 65:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), and BMP4 (5 ng/ml).

Medium 66:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), and BMP4 (5 ng/ml).

Medium 67:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), and BMP4 (5 ng/ml).

Medium 68:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), P38i (BIRB796, 0.1 μM), ROCKi (Y27632, 2 μM), and BMP4 (5 ng/ml).

Medium 69:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), and BMPi (LDN-193189, 0.2 μM).

Medium 70:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), and BMPi (LDN-193189, 0.2 μM).

Medium 71:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), SRCi (CGP77675, 1.5 μM), and BMPi (LDN-193189, 0.2 μM).

Medium 72:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), P38i (BIRB796, 0.1 μM), and BMPi (LDN-193189, 0.2 μM).

Medium 73:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), and FGFRi (PD173074, 0.1 μM).

Medium 74:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), and FGFRi (PD173074, 0.1 μM).

Medium 75:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), SRCi (CGP77675, 1.5 μM), and FGFRi (PD173074, 0.1 μM).

Medium 76:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), P38i (BIRB796, 0.1 μM), and FGFRi (PD173074, 0.1 μM).

Medium 77:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), SRCi (CGP77675, 1.5 μM), and FGFRi (PD173074, 0.1 μM).

Medium 78:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), P38i (BIRB796, 0.1 μM), and FGFRi (PD173074, 0.1 μM).

Medium 79:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), P38i (BIRB796, 0.1 μM), and FGFRi (PD173074, 0.1 μM).

Medium 80:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), SRCi (CGP77675, 1.5 μM), FGFRi (PD173074, 0.1 μM), and P38i (BIRB796, 1 μM).

Medium 81:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), SRCi (CGP77675, 1.5 μM), RAFi (SB590885, 0.5 μM), and Activin A (20 ng/ml).

Medium 82:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), RAFi (SB590885, 0.5 μM), SRCi (CGP77675, 1.5 μM), and Activin A (20 ng/ml).

Medium 83:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), RAFi-SB590885, 0.5 μM, P38i (BIRB796, 0.1 μM), and Activin A (20 ng/ml).

Medium 84:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), P38i (BIRB796, 0.1 μM), SRCi (CGP77675, 1.5 μM), and Activin A (20 ng/ml).

Medium 85:
LIF (20 ng/ml), ERK1/2i (PD0325901 1 μM), AXINs (IWR1 2.5 μM), PKCi (Go6983 2 μM), GSK3βi (CHIR99021 1.5 μM), L-ascorbic acid (50 μg/ml), ROCKi (Y27632 2 μM), and Activin A (20 ng/ml).

Medium 86:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), and Activin A (20 ng/ml).

Medium 87:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), and Activin A (20 ng/ml).

Medium 88:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), P38i (BIRB796, 0.1 μM), ROCKi (Y27632, 2 μM), and Activin A (20 ng/ml).

Medium 89:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), and TGFRi (SB431542, 2 μM).

Medium 90:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), and TGFRi (SB431542, 2 μM).

Medium 91:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), SRCi (CGP77675, 1.5 μM), TGFRi (SB431542, 2 μM).

Medium 92:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), P38i (BIRB796, 0.1 μM), and TGFRi (SB431542, 2 μM).

Medium 93:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), FGFRi (PD173074, 0.1 μM), and TGFRi (SB431542, 2 μM).

Medium 94:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), FGFRi (PD173074, 0.1 μM) and TGFRi (SB431542, 2 μM).

Medium 95:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), FGFRi (PD173074, 0.1 μM), TGFRi (SB431542, 2 μM), and SRCi (CGP77675, 1.5 μM).

Medium 96:
LIF (20 ng/ml), ERK1/2i (PD0325901, 1 μM), AXINs (IWR1, 5 μM), PKCi (Go6983 2 μM), GSK3βi (CHIR99021, 1.5 μM), L-ascorbic acid (50 μg/ml), ROCKi (Y27632, 2 μM), P38i (BIRB796, 0.1 μM), FGFRi (PD173074, 0.1 μM), and TGFRi (SB431542, 2 μM).

Medium 97:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), SRCi (CGP77675, 1.5 μM), FGFRi (PD173074, 0.1 μM), and TGFRi (SB431542, 2 μM).

Medium 98:
LIF (20 ng/ml), ERK1/2i (PD0325901 1 μM), AXINs (IWR1, 5 μM), PKCi (Go6983, 2 μM), GSK3βi (CHIR99021, 1.5 μM), L-ascorbic acid (50 μg/ml), ROCKi (Y27632, 2 μM), RAFi (SB590885, 0.5 μM), FGFRi (PD173074, 0.1 μM), and TGFRi (SB431542, 2 μM).

Medium 99:
LIF (20 ng/ml), ERK1/2i (PD0325901, 1 μM), AXINs (IWR1, 5 μM), PKCi (Go6983, 2 μM), GSK3βi (CHIR99021, 1.5 μM), L-ascorbic acid (50 μg/ml), SRCi (CGP77675, 1.5 μM), FGFRi (PD173074, 0.1 μM), TGFRi (SB431542, 2 μM) and P38i (BIRB796, 0.1 μM).

Medium 100:
LIF (20 ng/ml), ERK1/2i (PD0325901, 1 μM), AXINs (IWR1, 5 μM), PKCi (Go6983, 4 μM), GSK3βi (CHIR99021, 3 μM), and L-ascorbic acid (50 μg/ml).

Medium 101:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml) and ROCKi (Y27632, 2 μM).

Medium 102:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml) and P38i (BIRB796, 2 μM).

Medium 103:
LIF (20 ng/ml), ERK1/2i (PD0325901, 1 μM), AXINs (IWR1, 5 μM), PKCi (Go6983, 4 μM), GSK3βi (CHIR99021 3 μM), L-ascorbic acid (50 μg/ml), ROCKi (Y27632, 2 μM) and P38i (BIRB796, 2 μM).

Medium 104:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM) and JNKi (SP600125, 5 μM).

Medium 105:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), P38i (BIRB796, 2 μM) and JNKi (SP600125, 5 μM).

Medium 106:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM), and ERK5i (BIX02189, 5 μM).

Medium 107:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), P38i (BIRB796, 2 μM), and ERK5i (BIX02189, 5 μM).

Medium 108:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml) and TGFRi (SB431542, 2 μM).

Medium 109:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), and TGFRi (SB431542, 2 μM).

Medium 110:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), and FGFRi (PD173074, 0.1 μM).

Medium 111:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), and FGFRi (PD173074, 0.1 μM).

Medium 112:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM), and TGFRi (SB431542, 2 μM).

Medium 113:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), P38i (BIRB796, 2 μM) and TGFRi (SB431542, 2 μM).

Medium 114:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM) and FGFRi (PD173074, 0.1 μM).

Medium 115:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), P38i (BIRB796, 2 μM), and FGFRi (PD173074, 0.1 μM).

Medium 116:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), and LSDi (TCP, 5 μM).

Medium 117:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM) and LSDi (TCP, 5 μM).

Medium 118:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM) and LSDi (TCP, 5 μM).

Medium 119:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM) and LSDi (TCP, 5 μM).

Medium 120:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml) and Forskolin (5 μM).

Medium 121:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM) and Forskolin (5 μM).

Medium 122:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM), and Forskolin (5 μM).

Medium 123:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632 2, μM), P38i (BIRB796, 2 μM), and Forskolin (5 μM).

Medium 124:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), and DOT1Li (SGC0946, 5 μM).

Medium 125:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), and DOT1Li (SGC0946, 5 μM).

Medium 126:
LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM) and DOT1Li (SGC0946, 5 μM).

Medium 127:

LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), P38i (BIRB796, 2 μM), and DOT1Li (SGC0946, 5 μM).

Medium 128:

LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), P38i (BIRB796, 2 μM), JNKi (SP600125 5 μM), and ERK5i (BIX02189, 5 μM).

Medium 129:

LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM), P38i (BIRB796, 2 μM), JNKi (SP600125, 5 μM), and ERK5i (BIX02189, 5 μM).

Medium 130:

LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), and ERK5i (BIX02189, 5 μM).

Medium 131:

LIF (20 ng/ml), ERK1/2i (PD0325901, 1 μM), AXINs (IWR1, 5 μM), PKCi (Go6983, 4 μM), GSK3βi (CHIR99021, 3 μM), L-ascorbic acid (50 μg/ml), ROCKi (Y27632, 2 μM) and ERK5i (BIX02189, 5 μM).

As mentioned, the culture medium of some embodiments of the invention is capable of maintaining naïve PSC in a naïve state, wherein:

(i) when the naive PSC is a female PSC, then the naive female PSC has two unmethylated alleles of the promoter of the X-inactive specific transcript (XIST) gene; and (ii) when the naive PSC is a male PSC, then the naive male PSC has an unmethylated allele of the promoter of the XIST gene, and/or an expression level of transcription factor E3 (TFE3) in said naive PSC is characterized by a nucleus to cytoplasm expression ratio which is equal to or higher than 1 as determined by an immunostaining assay.

FIGS. 17A-E show examples of such unmethylated alleles as determining in the XIST promoter (in the amplicon set forth in SEQ ID NO:70). These results conclusively demonstrate that male and female Naive hESCs/iPSCs which are cultured on all of the tested culture media retain a unique pre-X inactivation state under various WIS-NHSM conditions.

In contrast, FIG. 17F shows an example of a non-naïve cell in which the XIST allele in the male cell is completely methylated (i.e., most of the CpG sites in the XIST promoter are methylated), and one allele of the promoter of the XIST gene is methylated in the female cell.

In addition, Table 1 herein below, summarizes the Relative Nuclear/Cytoplasmic TFE3 Enrichment (average value) in naïve PSCs cultured in the culture medium of some embodiments of the invention.

TABLE 1

Table 1: Naïve PSCs were expanded in the indicated culture media for 14 days on DR4 irradiate MEF cells and 0.2% gelatin coated plates in 5% O2 conditions at 37° C. All culture media included L-ascorbic acid (at a final concentration of 50 μg/ml). Key for small molecule abbreviation: LIF (20 ng/ml), ERK1/2i (PD0325901 1 μM), AXINs (IWR1 5 μM), PKCi (Go6983 4 μM), GSK3βi (CHIR99021 1.5 μM), P38i (BIRB796 2 μM), JNKi (SP600125 5 μM), SRCi (CGP77675 1 μM).

| Relative Nuclear/Cytoplasmic TFE3 Enrichment (average value) | Culture medium comprises: |
|---|---|
| 1.4 | Srci 1 μM, ERK1/2i 1 μM, LIF 20 ng/ml |
| 1.4 | AXINs 5 μM, ERK1/2i 1 μM, LIF 20 ng/ml |
| 1.7 | AXINs 5 μM, ERK1/2i 1 μM, LIF 20 ng/ml, PKCi 4 μM, GSK3i 1.5 μM |
| 1.7 | AXINs 5 μM, ERK1/2i 1 μM, LIF 20 ng/ml, PKCi 4 μM, GSK3i 1.5 μM, P38i 2 μM, JNKi 5 μM |
| 1.7 | AXINs 5 μM, ERK1/2i 1 μM, LIF 20 ng/ml, PKCi 4 μM, GSK3i 1.5 μM, P38i 2 μM, JNKi 5 μM, SRCi 1 μM |

As shown in the above Table 1, all of the tested culture media were capable of maintaining the naïve PSCs in a naïve state which is characterized by a ratio higher than 1 between the nuclear and cytoplasmic TFE3 enrichment.

Example 6

Materials and Methods
Base Medium

1:1 mix of Neurobasal Medium (Invitrogen 21103-049) and DMEM/F12 (Biological Industries 06-1170-50-1A)—total 475 ml. Alternatively, 475 ml of the DMEM/F12 (Biological Industries 06-1170-50-1A without HEPES). The medium was supplemented with: Pen-strep 5 ml (Biological Industries 03-033-1B), L-glutamine 5 ml of 200 mM solution (at a 2 mM final concentration) (Biological Industries—02-022-1B), Non-Essential Amino Acid (NEAA; Biological Industries 01-340-1B)—5 ml of the X100 solution into a total of 500 ml medium [Composition of the X100 solution: L-Alanine 0.89 gram/liter; L-Asparagine·H2O 1.50 gram/liter; L-Aspartic Acid 1.33 gram/liter; L-Glutamic Acid 1.47 gram/liter; Glycine 0.75 gram/liter; L-Proline 1.15 gram/liter; and L-Serine 1.05 gram/liter], 50 μl of 50 mM stock Beta-mercaptoethanol (1 vile), 10 ml B27 supplement (Invitrogen 17504-044) or Xeno-free B27 (Invitrogen A14867-01), Insulin (Sigma I-1882; 12.5 μg/ml final concentration), Apo-transferrin (Sigma T-1147; 100 μg/ml final concentration), Progesterone (Sigma P8783, 0.02 μg/ml final concentration), Putrescine (Sigma P5780; 16 μg/ml final concentration), Sodium selenite (Sigma S5261; 5 μl of 3 mM stock solution per 500 ml medium, resulting in a final concentration of 3 nM), human serum albumin (10% solution from Biological Industries 05-720-1B, add 2 ml per 500 ml media bottle, resulting in a final concentration of 0.4% Human Serum Albumin) or bovine serum albumin (BSA) (100× Fraction V 7.5% Solution Gibco 15260-037, add 0.16 ml per 500 ml media bottle, resulting in a final concentration of 0.0024% BSA).

It is noted that the base medium according to some embodiments of the invention does not include ascorbic acid, and that ascorbic acid can be supplemented in some media as shown below.

FIG. 18 schematically illustrates the composition of the medium of some embodiments of the invention.

FIG. 19 provides non-limiting examples of culture media supplements (conditions 132-147 in FIG. 19) which are added to the base medium described hereinabove (in Example 6), as follows:

Supplements
Medium 132:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), G9ai (BIX01294, 0.5 μM), and ROCKi (Y27632, 2 μM).

Medium 133:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), and G9ai (BIX01294, 0.5 μM).

Medium 134:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), SRCi (CGP77675, 0.5 μM), P38i (BIRB796, 0.25 μM), G9ai (BIX01294, 0.5 μM), and ROCKi (Y27632, 2 μM).

Medium 135:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), and ROCKi (Y27632, 2 μM).

Medium 136:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), G9ai (BIX01294, 0.5 μM), and ROCKi (Y27632, 2 μM)

Medium 137:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), and G9ai (BIX01294, 0.5 μM).

Medium 138:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), SRCi (CGP77675, 0.5 μM), G9ai (BIX01294, 0.5 μM), and ROCKi (Y27632, 2 μM).

Medium 139:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), and ROCKi (Y27632, 2 μM).

Medium 140:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), G9ai (BIX01294, 0.5 μM), ROCKi (Y27632, 2 μM), and RAFi (SB590885, 0.25 μM).

Medium 141:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), G9ai (BIX01294, 0.5 μM), and RAFi (SB590885, 0.25 μM), Medium 142:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), SRCi (CGP77675, 0.5 μM), P38i (BIRB796, 0.25 μM), G9ai (BIX01294, 0.5 μM), ROCKi (Y27632, 2 μM), and RAFi (SB590885, 0.25 μM)

Medium 143:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), ROCKi (Y27632, 2 μM), and RAFi (SB590885, 0.25 μM.

Medium 144:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), G9ai (BIX01294, 0.5 μM), ROCKi (Y27632, 2 μM), and SCF (20 ng/ml)

Medium 145:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), G9ai (BIX01294, 0.5 μM), and SCF (10 ng/ml), Medium 146:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), SRCi (CGP77675, 0.5 μM), P38i (BIRB796, 0.25 μM), G9ai (BIX01294, 0.5 μM), ROCKi (Y27632, 2 μM), and SCF (10 ng/ml).

Medium 147:
LIF (20 ng/ml), ERK1/2i (PD0325901, 1 μM), AXINs (IWR1, 5 μM), PKCi (Go6983, 2 μM), JNKi (SP600125, 5 μM), GSK3βi (CHIR99021, 1.5 μM), L-ascorbic acid (50 μg/ml), SRCi (CGP77675, 0.5 μM), P38i (BIRB796, 0.25 μM), ROCKi (Y27632, 2 μM), and SCF (10 ng/ml).

Experimental Results

FIGS. 20-21 demonstrate that any of the culture media described hereinabove (Media 132-147) maintain human pluripotent stem cells in a naive undifferentiated and pluripotent state.

FIGS. 22A-C show examples of methylation assays of the XIST promoter (in the amplicon set forth in SEQ ID NO:70) for the naïve and primed pluripotent stem cells. These results of FIGS. 22A-B conclusively demonstrate that male and female Naive hESCs/iPSCs which are cultured on all of the tested culture media retain a unique pre-X inactivation state under various WIS-NHSM conditions.

In contrast, FIG. 22C shows an example of a non-naïve cell in which the XIST allele in the male cell is completely methylated (i.e., most of the CpG sites in the XIST promoter are methylated), and one allele of the promoter of the XIST gene is methylated in the female cell.

To test the ability of the culture medium of some embodiments of the invention to maintain a naïve PSC state, the level of TFE3 was measured in the nucleus and cytoplasm of the cells, and the relative ratio was determined. WIBR3 hESCs were expanded in the indicated conditions for 14 days on Matrigel coated plates in 5% $O_2$ conditions at 37° C. All culture media included L-ascorbic acid (50 μg/ml).

Table 2 herein below, summarizes the Relative Nuclear/Cytoplasmic TFE3 Enrichment (average value) in naïve PSCs cultured in the culture medium of some embodiments of the invention.

TABLE 2

Table 2: Naïve PSCs were expanded in the indicated culture media for 14 days on DR4 irradiate MEF cells and 0.2% gelatin coated plates in 5% O2 conditions at 37° C. All culture media included L-ascorbic acid (at a final concentration of 50 µg/ml). Key for small molecule abbreviation: Key for small molecule abbreviation: LIF (20 ng/ml), ERK1/2i (PD0325901 1 µM), AXINs (IWR1 5 µM), PKCi (Go6983 2 µM), GSK3βi (CHIR99021 1.5 µM), P38i (BIRB796 0.25 µM), JNKi (SP600125 5 µM), SRCi (CGP77675 0.5 µM), and G9ai (BIX01294 0.5 µM).

| Relative Nuclear/ Cytoplasmic TFE3 Enrichment (average value) | Culture medium comprises: |
|---|---|
| 1.8 | AXINs 5 µM, ERK1/2i 1 µM, LIF 20 ng/ml, PKCi 2 µM, GSK3i 1.5 µM, P38i 0.25 µM, JNKi 5 µM, SRCi 0.5 µM |
| 1.9 | AXINs 5 µM, ERK1/2i 1 µM, LIF 20 ng/ml, PKCi 2 µM, GSK3i 1.5 µM, P38i 0.25 µM, JNKi 5 µM, SRCi 0.5 µM, G9ai 0.5 µM |
| 0.6 | Conditions for primed WIBR3 ESCs as Negative control: Primed cells expanded in mTESR™ (FGF2/TGFbeta1) Conditions (by Stem Cell Technologies) |

As shown in Table 2 above, Naive hESCs/iPSCs retain preferential TFE3 nuclear localizations. Thus, all of the tested culture media for naïve conditions were capable of maintaining the naïve PSCs in a naïve state which is characterized by a ratio higher than 1 between the nuclear and cytoplasmic TFE3 enrichment. In contrast, when conditions for primed PSCs were used (e.g., mTESR™ (FGF2/TGFbeta1) Conditions (by Stem Cell Technologies)) the ration between the nuclear to cytoplasmic TFE3 was lower than 1.

Example 7

Previously described HUES64 cell line that lacks endogenous DNA methyltransferase 1 (DNMT1) alleles and retain an exogenous DNMT1 allele under a Tet-Off promoter (Liao J, et al. 2015. "Targeted disruption of DNMT1, DNMT3A and DNMT3B in human embryonic stem cells". Nat Genet. 2015 May; 47(5):469-78. doi: 10.1038/ng.3258. Epub 2015 Mar. 30; which is fully incorporated herein as reference) was used in the following experiment. Cells were expanded in the indicated conditions (Table 3 below), with or without Doxycycline for 10 passages (P10) on Gelatin/DR4 coated plates, and cultures were immunostained for OCT4 pluripotency marker in surviving cells. Primed cells, which were expanded in mTESR™ do not tolerate loss of DNMT1 expression induced by addition of DOX on these engineered cells. Cells expanded in the culture medium of some embodiments of the invention (Medium number 138 and 136 retain their pluripotency as is indicated by the high percentage of OCT4 positive cells (93% and 97%) despite the loss of DNMT1 expression in this engineered system (upper two examples). These results indicate how human naïve, but not primed, pluripotent cells can maintain their pluripotency in spite of DNMT1 loss of expression.

TABLE 3

Table 3: Key for small molecule abbreviation: LIF (20 ng/ml), ERK1/2i (PD0325901 1 µM), AXINs (IWR1 5 µM), PKCi (Go6983 2 µM), GSK3βi (CHIR99021 1.5 µM) P38i (BIRB796 0.25 µM), JNKi (SP600125 5 µM), SRCi (CGP77675 0.5 µM), G9ai (BIX01294 0.5 µM), ROCKi (Y27632 2 µM).

| % OCT4+ cells at P10 | | |
|---|---|---|
| NO DOX | ++DOX (1 µg/ml) | Culture medium comprises: |
| 95 | 93 | Medium 138: AXINs 5 µM, ERK1/2i 1 µM, LIF 20 ng/ml, PKCi 2 µM, GSK3βi 1.5 µM, JNKi 5 µM, SRCi 0.5 µM, G9ai 0.5 µM, ROCKi 2 µM |
| 95 | 97 | Medium 136: AXINs 5 µM, ERK1/2i 1 µM, LIF 20 ng/ml PKCi 2 µM, GSK3βi 1.5 µM, P38i 0.25 µM, JNKi 5 µM, SRCi 0.5 µM, G9ai 0.5 µM, ROCKi 2µM |
| 95 | 0 | Primed WIBR3 ESCs as Negative control: Primed cells expanded in mTESR™ (FGF2/TGFbeta1) Conditions (by Stem Cell Technologies) |

Example 8

The Naïve PSCS of the Invention can be Used for Generating Same or Cross-Species Chimeras Injecting naïve PSCs from one species into the early embryo of another species are likely to be outcompeted due to a variety of reasons including: difference in cell cycle progression, reduced reactivity to host morphogenesis, difference in gestation timing and the like. To increase the efficiency of chimerism in a host animal, the present inventors have uncovered that the principle of "Cell Cheating" or "Cell competition" can be employed in cross-species chimeric assays. For this purpose, the present inventors employed the isolated naïve human PSCs which maintain the "naïve state" and genetically engineered them to exhibit reduced levels of P53. The isolated genetically engineered naïve PSC, with reduced p53 expression were further injected into host mouse embryos, and the developing embryos were analyzed for chimerism levels. As shown below, while the wild type (WT) naïve PSCs were shown capable of contributing to developing mouse embryos, "cheater" P53 depleted naïve PSCs yielded remarkably higher contribution efficiency in chimerism levels.

Experimental Methods:

Generation of the LIS38 tg-pTrip lck EGFPp53 Crispr C2 Clone—

The present inventors have applied the CRISPR/CAS9 technology to generate mutants depleted for P53 protein. sgRNA (single stranded guide RNA) sequence targeting EXON3 of human P53 was designed, and naïve PSCs having a deletion in this region were established and validated for depletion in p53 protein levels. These cell lines were used as "super-competitors" in cross-species chimerism assays, as they were microinjected into E2.5 mouse embryos, and allowed to develop further to test for human (GFP+) cell detection in developing mouse embryos.

Experimental Results

Microinjection of LIS 38 EGFP hTP53 C2 Naive Human iPS Cells into Mouse Morulas Generates Cross-Species Chimaeric Humanized Mice FIGS. 23A-D depict the generation of the LIS38 tg-pTrip lck EGFP p53 crispr C2 clone, and the absence of p53 expression in PSC cells of this clone.

As is shown in FIGS. 24A-B, embryos injected with the LIS 38 EGFP hTP53 C2 naive human iPS cells into mouse morulas generates cross-species chimaeric humanized mice. Shown are representative images demonstrating widespread integration of GFP-labeled human naive iPS-derived cells into different locations of an E9.5 mouse embryo. Hoechst and CellTracker were used for counterstaining.

These results conclusively show that the naïve human or non-human primate iPSCs/ESCs that are depleted for P53 and/or overexpressing dominant negative P53 mutant, c-MYC, n-MYC, L-MYC, EDAR or ERAS (Dejosez M et al., 2013, Science. 2013 Sep. 27; 341(6153):1511-4; and Claveria C., et al., 2013, Nature. 500(7460):39-44) can be used as competitor cells when injected into host pre-implantation embryos (blastocyst, morula) of the same or a different species, to generate same-species or cross-species chimeras.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

REFERENCES

Additional References are Cited in Text

Ang, Y.-S., Tsai, S.-Y., Lee, D.-F., Monk, J., Su, J., Ratnakumar, K., Ding, J., Ge, Y., Darr, H., Chang, B., et al. (2011). Wdr5 mediates self-renewal and reprogramming via the embryonic stem cell core transcriptional network. Cell 145, 183-197.

De Los Angeles, A., Loh, Y.-H., Tesar, P. J., and Daley, G. Q. (2012). Accessing naive human pluripotency. Curr. Opin. Genet. Dev. 22, 272-282.

Durcova-Hills, G., Tang, F., Doody, G., Tooze, R., and Surani, M. A. (2008). Reprogramming primordial germ cells into pluripotent stem cells. PLoS ONE 3, e3531.

Fidalgo, M., Faiola, F., Pereira, C.-F., Ding, J., Saunders, A., Gingold, J., Schaniel, C., Lemischka, I. R., Silva, J. C. R., and Wang, J. (2012). Zfp281 mediates Nanog autorepression through recruitment of the NuRD complex and inhibits somatic cell reprogramming. Proc. Natl. Acad. Sci. U.S.a. 109, 16202-16207.

Hanna, J. H. (2010). The STATs on naive iPSC reprogramming. Cell Stem Cell 7, 274-276.

Hanna, J. H., Saha, K., and Jaenisch, R. (2010a). Pluripotency and cellular reprogramming: facts, hypotheses, unresolved issues. Cell 143, 508-525.

Hanna, J., Cheng, A. W., Saha, K., Kim, J., Lengner, C. J., Soldner, F., Cassady, J. P., Muffat, J., Carey, B. W., and Jaenisch, R. (2010b). Human embryonic stem cells with biological and epigenetic characteristics similar to those of mouse ESCs. Proc. Natl. Acad. Sci. U.S.a. 107, 9222-9227.

Hanna, J., Markoulaki, S., Mitalipova, M., Cheng, A. W., Cassady, J. P., Staerk, J., Carey, B. W., Lengner, C. J., Foreman, R., Love, J., et al. (2009a). Metastable pluripotent states in NOD-mouse-derived ESCs. Cell Stem Cell 4, 513-524.

Hanna, J., Saha, K., Pando, B., van Zon, J., Lengner, C. J., Creyghton, M. P., van Oudenaarden, A., and Jaenisch, R. (2009b). Direct cell reprogramming is a stochastic process amenable to acceleration. Nature 462, 595-601.

Hockemeyer, D., Wang, H., Kiani, S., Lai, C. S., Gao, Q., Cassady, J. P., Cost, G. J., Zhang, L., Santiago, Y., Miller, J. C., et al. (2011). Genetic engineering of human pluripotent cells using TALE nucleases. Nat Biotechnol 29, 731-734.

Kaji, K., Caballero, I. M., MacLeod, R., Nichols, J., Wilson, V. A., and Hendrich, B. (2006). The NuRD component Mbd3 is required for pluripotency of embryonic stem cells. Nat Cell Biol 8, 285-292.

Kaji, K., Nichols, J., and Hendrich, B. (2007). Mbd3, a component of the NuRD co-repressor complex, is required for development of pluripotent cells. Development 134, 1123-1132.

Lengner, C. J., Gimelbrant, A. A., Erwin, J. A., Cheng, A. W., Guenther, M. G., Welstead, G. G., Alagappan, R., Frampton, G. M., Xu, P., Muffat, J., et al. (2010). Derivation of pre-X inactivation human embryonic stem cells under physiological oxygen concentrations. Cell 141, 872-883.

Li, W., Wei, W., Zhu, S., Zhu, J., Shi, Y., Lin, T., Hao, E., Hayek, A., Deng, H., and Ding, S. (2009). Generation of rat and human induced pluripotent stem cells by combining genetic reprogramming and chemical inhibitors. Cell Stem Cell 4, 16-19.

Mansour, A. A., Gafni, O., Weinberger, L., Zviran, A., Ayyash, M., Rais, Y., Krupalnik, V., Zerbib, M., Amann-Zalcenstein, D., Maza, I., et al. (2012). The H3K27 demethylase Utx regulates somatic and germ cell epigenetic reprogramming. Nature 488, 409-413.

Marks, H., Kalkan, T., Menafra, R., Denissov, S., Jones, K., Hofemeister, H., Nichols, J., Kranz, A., Francis Stewart, A., Smith, A., et al. (2012). The transcriptional and epigenomic foundations of ground state pluripotency. Cell 149, 590-604.

Mikkelsen, T. S., Hanna, J., Zhang, X., Ku, M., Wernig, M., Schorderet, P., Bernstein, B. E., Jaenisch, R., Lander, E. S., and Meissner, A. (2008). Dissecting direct reprogramming through integrative genomic analysis. Nature 454, 49-55.

Nichols, J., and Smith, A. (2012). Pluripotency in the embryo and in culture. Cold Spring Harb Perspect Biol 4, a008128.

Okamoto, I., Patrat, C., Thépot, D., Peynot, N., Fauque, P., Daniel, N., Diabangouaya, P., Wolf, J.-P., Renard, J.-P., Duranthon, V., et al. (2011). Eutherian mammals use diverse strategies to initiate X-chromosome inactivation during development. Nature 1-7.

Onder, T. T., Kara, N., Cherry, A., Sinha, A. U., Zhu, N., Bernt, K. M., Cahan, P., Marcarci, B. O., Unternaehrer, J., Gupta, P. B., et al. (2012). Chromatin-modifying enzymes as modulators of reprogramming. Nature 483, 598-602.

Orkin, S. H., and Hochedlinger, K. (2011). Chromatin Connections to Pluripotency and Cellular Reprogramming. Cell 145, 835-850.

Polo, J. M., Anderssen, E., Walsh, R. M., Schwarz, B. A., Nefzger, C. M., Lim, S. M., Borkent, M., Apostolou, E., Alaei, S., Cloutier, J., et al. (2012). A Molecular Roadmap of Reprogramming Somatic Cells into iPS Cells. Cell 151, 1617-1632.

Pribluda, A., and Hanna, J. H. (2012). Tracing the genesis of human embryonic stem cells. Nat Biotechnol 30, 247-249.

Roode, M., Blair, K., Snell, P., Elder, K., Marchant, S., Smith, A., and Nichols, J. (2012). Human hypoblast formation is not dependent on FGF signalling. Dev. Biol. 361, 358-363.

Silva, J., Nichols, J., Theunissen, T. W., Guo, G., van Oosten, A. L., Barrandon, O., Wray, J., Yamanaka, S., Chambers, I., and Smith, A. (2009). Nanog is the gateway to the pluripotent ground state. Cell 138, 722-737.

Smith, Z. D., Nachman, I., Regev, A., and Meissner, A. (2010). Dynamic single-cell imaging of direct reprogramming reveals an early specifying event. Nat Biotechnol 28, 521-526.

Soufi, A., Donahue, G., and Zaret, K. S. (2012). Facilitators and Impediments of the Pluripotency Reprogramming Factors' Initial Engagement with the Genome. Cell 1-11.

Sridharan, R., Tchieu, J., Mason, M. J., and Yachechko, R. (2009). ScienceDirect(dot)com—Cell—Role of the Murine Reprogramming Factors in the Induction of Pluripotency. Cell.

Takahashi, K., and Yamanaka, S. (2006). Induction of pluripotent stem cells from mouse embryonic and adult fibroblast cultures by defined factors. Cell 126, 663-676.

Tesar, P. J., Chenoweth, J. G., Brook, F. A., Davies, T. J., Evans, E. P., Mack, D. L., Gardner, R. L., and McKay, R. D. G. (2007). New cell lines from mouse epiblast share defining features with human embryonic stem cells. Nature 448, 196-199.

Tiwari, V. K., Stadler, M. B., Wirbelauer, C., Paro, R., Schübeler, D., and Beisel, C. (2011). A chromatin-modifying function of JNK during stem cell differentiation. Nat Genet.

Tomoda, K., Takahashi, K., Leung, K., Okada, A., Narita, M., Yamada, N. A., Eilertson, K. E., Tsang, P., Baba, S., White, M. P., et al. (2012). Derivation conditions impact x-inactivation status in female human induced pluripotent stem cells. Cell Stem Cell 11, 91-99.

Warren, L., Ebina, W., Mandal, P. K., Smith, Z. D., Meissner, A., and Daley, G. Q. (2010). ScienceDirect(dot)com—Cell Stem Cell—Highly Efficient Reprogramming to Pluripotency and Directed Differentiation of Human Cells with Synthetic Modified mRNA. Cell Stem Cell.

Wernig, M., Lengner, C. J., Hanna, J., Lodato, M. A., Steine, E., Foreman, R., Staerk, J., Markoulaki, S., and Jaenisch, R. (2008). A drug-inducible transgenic system for direct reprogramming of multiple somatic cell types. Nat Biotechnol 26, 916-924.

Ying, Q.-L., Wray, J., Nichols, J., Batlle-Morera, L., Doble, B., Woodgett, J., Cohen, P., and Smith, A. (2008). The ground state of embryonic stem cell self-renewal. Nature 453, 519-523.

Zhu, D., Fang, J., Li, Y., and Zhang, J. (2009). Mbd3, a Component of NuRD/Mi-2 Complex, Helps Maintain Pluripotency of Mouse Embryonic Stem Cells by Repressing Trophectoderm Differentiation. PLoS ONE 4, e7684.

SEQUENCE LISTING (222 sequences)

SEQ ID NO: 1 - DNA, 30 bp, Artificial sequence
  Single strand DNA oligonucleotide
ggtaccggatactcaggccaggcccagaaa

SEQ ID NO: 2 - DNA, 25 bp, Artificial sequence
  Single strand DNA oligonucleotide
ctcgagtccacagacctctggcact

SEQ ID NO: 3 - DNA, 35 bp, Artificial sequence
  Single strand DNA oligonucleotide
ggtacccattgagtccaaatcctctttactaggtg

SEQ ID NO: 4 - DNA, 25 bp, Artificial sequence
  Single strand DNA oligonucleotide
ctcgagctgaggctcatgctgctgg

SEQ ID NO: 5 - protein, 605 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 6 - protein, 411 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 7 - protein, 291 aa, Homo sapiens
MERKRWECPALPQGWEREEVPRRSGLSAGHRDVFYYSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 8 - protein, 580 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 9 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 10 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 11 - protein, 1912 aa, Homo sapiens
MASGLGSPSPCSAGSEEEDMDALLNNSLPPPHPENEEDPEEDLSETETPKLKKKKKPKKPRDPKIPKSKRQKKERMLLCRQLGDSSGEGPEFVEEEEEVALRSDSEGSDYTPGKKKKKKLGPKKEKKSKSKRKEEEEEEDDDDDSKEPKSSAQLLEDWGMEDIDHVFSEEDYRTLTNYKAFSQFVRPLIAAKNPKIAVSKMMMVLGAKWREFSTNNPFKGSSGASVAAAAAAAVAVVESMVTATEVAPPPPPVEVPIRKAKTKEGKGPNARRKPKGSPRVPDAKKPKPKKVAPLKIKLGGFGSKRKRSSSEDDDLDVESDFDDASINSYSVSDGSTSRSSRSRKKLRTTKKKKKGEEEVTAVDGYETDHQDYCEVCQQGGEIILCDTCPRAYHMVCLDPDMEKAPEGKWSCPHCEKEGIQWEAKEDNSEGEEILEEVGGDLEEEDDHHMEFCRVCKDGGELLCCDTCPSSYHIHCLNPPLPEIPNGEWLCPRCTCPALKGKVQKILIWKWGQPPSPTPVPRPPDADPNTPSPKPLEGRPERQFFVKWQGMSYWHCSWVSELQLELHCQVMFRNYQRKNDMDEPPSGDFGGDEEKSRKRKNKDPKFAEMEERFYRYGIKPEWMMIHRILNHSVDKKGHVHYLIKWRDLPYDQASWESEDVEIQDYDLFKQSYWNHRELMRGEEGRPGKKLKKVKLRKLERPPETPTVDPTVKYERQPEYLDATGGTLHPYQMEGLNWLRFSWAQGTDTILADEMGLGKTVQTAVFLYSLYKEGHSKGPFLVSAPLSTIINWEREFEMWAPDMYVVTYVGDKDSRAIIRENEFSFEDNAIRGGKKASRMKKEASVKFHVLLTSYELITIDMAILGSIDWACLIVDEAHRLKNNQSKFFRVLNGYSLQHKLLLTGTPLQNNLEELFHLLNFLTPERFHNLEGFLEEFADIAKEDQIKKLHDMLGPHMLRRLKADVFKNMPSKTELIVRVELSPMQKKYYKYILTRNFEALNARGGGNQVSLLNVVMDLKKCCNHPYLFPVAAMEAPKMPNGMYDGSALIRASGKLLLLQKMLKNLKEGGHRVLIFSQMTKMLDLLEDFLEHEGYKYERIDGGITGNMRQEAIDRFNAPGAQQFCFLLSTRAGGLGINLATADTVIIYDSDWNPHNDIQAFSRAHRIGQNKKVMIYRFVTRASVEERITQVAKKKMMLTHLVVRPGLGSKTGSMSKQELDDILKFGTEELFKDEATDGGGDNKEGEDSSVIHYDDKAIERLLDRNQDETEDTELQGMNEYLSSFKVAQYVVREEEMGEEEEVEREIIKQEESVDPDYWEKLLRHHYEQQQEDLARNLGKGKRIRKQVNYNDGSQEDRDWQDDQSDNQSDYSVASEEGDEDFDERSEAPRRPSRKGLRNDKDKPLPPLLARVGGNIEVLGFNARQRKAFLNAIMRYGMPPQDAFTTQWLVRDLRGKSEKEFKAYVSLFMRHLCEPGADGAETFADGVPREGLSRQHVLTRIGVMSLIRKKVQEFEHVNGRWSMPELAEVEENKKMSQPGSPSPKTPTPSTPGDTQPNTPAPVPPAEDGIKIEENSLKEEESIEGEKEVKSTAPETAIECTQAPAPASEDEKVVVEPPEGEEKVEKAEVKERTEEPMETEPKGAADVEKVEEKSAIDLTPIVVEDKEEKKEEEEKKEVMLQNGETPKDLNDEKQKKNIKQRFMFNIADGGFTELHSLWQNEERAATVTKKTYEIWHRRHDYWLLAGIINHGYARWQDIQNDPRYAILNEPFKGEMNRGNFLEIKNKFLARRFKLLEQALVIEEQLRRAAYLNMSEDPSHPSMALNTRFAEVECLAESHQHLSKESMAGNKPANAVLHKVLKQLEELLSDMKADVTRLPATIARIPPVAVRLQMSERNILSRLANRAPEPTPQQVAQQQ

SEQ ID NO: 12 - protein, 305 aa, Homo sapiens
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 13 - protein, 424 aa, Homo sapiens
MADKEAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 14 - protein, 1792 aa, Homo sapiens
MSCVHYKFSSKLNYDTVTFDGLHISLCDLKKQIMGREKLKAADCDLQITNAQTKEEYTDDNALIPKNSSVIVRRIPIGGVKSTSKTYVISRTEPAMATTKAIDDSSASISLAQLTKTANLAEANASEEDKIKAMMSQSGHEYDPINYMKKPLGPPPPSYTCFRCGKPGHYIKNCPTNGDKNFESGPRIKKSTGIPRSFMMEVKDPNMKGAMLTNTGKYAIPTIDAEAYAIGKKEKPPFLPEEPSSSSEEDDPIPDELLCLICKDIMTDAVVIPCCGNSYCDECIRTALLESDEHTCPTCHQNDVSPDALIANKFLRQAVNNFKNETGYTKRLRKQLPPPPPPIPPPRPLIQRNLQPLMRSPISRQQDPLMIPVTSSSTHPAPSISSLTSNQSSLAPPVSGNPSSAPAPVPDITATVSISVHSEKSDGPFRDSDNKILPAAALASEHSKGTSSIAITALMEEKGYQVPVLGTPSLLGQSLLHGQLIPTTGPVRINTARPGGGRPGWEHSNKLGYLVSPPQQIRRGERSCYRSINRGRHHSERSQRTQGPSLPATPVFVPVPPPPLYPPPPHTLPLPPGVPPPQFSPQFPPGQPPPAGYSVPPPGFPPAPANLSTPWVSSGVQTAHSNTIPTTQAPPLSREEFYREQRRLKEEEKKKSKLDEFTNDFAKELMEYKKIQKERRRSFSRSKSPYSGSSYSRSSYTYSKSRSGSTRSRSYSRSFSRSHSRSYSRSPPYPRRGRGKSRNYRSRSRSHGYHRSRSRSPPYRRYHSRSRSPQAFRGQSPNKRNVPQGETEREYFNRYREVPPPYDMKAYYGRSVDFRDPFEKERYREWERKYREWYEKYYKGYAAGAQPRPSANRENFSPERFLPLNIRNSPFTRGRREDYVGGQSHRSRNIGSNYPEKLSARDGHNQKDNTKSKEKESENAPGDGKGNKHKKHRKRRKGEESEGFLNPELLETSRKSREPTGVEENKTDSLFVLPSRDDATPVRDEPMDAESITFKSVSEKDKRERDKPKAKGDKTKRKNDGSAVSKKENIVKPAKGPQEKVDGERERSPRSEPPIKKAKEETPKTDNTKSSSSSQKDEKITGTPRKAHSKSAKEHQETKPVKEEKVKKDYSKDVKSEKLTTKEEKAKKPNEKNKPLDNKGEKRKRKTEEKGVDKDFESSSMKISKLEVTEIVKPSPKRKMEPDTEKMDRTPEKDKISLSAPAKKIKLNRETGKKIGSTENISNTKEPSEKLESTSSKVKQEKVKGKVRRKVTGTEGSSSTLVDYTSTSSTGGSPVRKSEEKTDTKRTVIKTMEEYNNDNTAPAEDVIIMIQVPQSKWDKDDFESEEEDVKSTQPISSVGKPASVIKNVSTKPSNIVKYPEKESEPSEKIQKFTKDVSHEIIQHEVKSSKNSASSEKGKTKDRDYSVLEKENPEKRKNSTQPEKESNLDRLNEQGNFKSLSQSSKEARTSDKHDSTRASSNKDFTPNRDKKTDYDTREYSSSKRRDEKNELTRRKDSPSRNKDSASGQKNKPREERDLPKKGTGDSKKSNSSPSRDRKPHDHKATYDTKRPNEETKSVDKNPCKDREKHVLEARNNKESSGNKLLYILNPPETQVEKEQITGQIDKSTVKPKPQLSHSSRLSSDLTRETDEAAFEPDYNESDSESNVSVKEEESSGNISKDLKDKIVEKAKESLDTAAVVQVGISRNQSHSSPSVSPSRSHSPSGSQTRSHSSSASSAESQDSKKKKKKKEKKKHKKHKKHKKHKKHAGTEVELEKSQKHKHKKKKSKKNKDKEKEKEKDDQKVKSVTV

SEQ ID NO: 15 - protein, 469 aa, Homo sapiens
MAAEAGVVGAGASPDGDWRDQACGLLLHVHLSSRLGRAAPVRTGRHLRTVFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 16 - protein, 482 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 17 - protein, 488 aa, Homo sapiens
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 18 - protein, 430 aa, Homo sapiens
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYMSSLRILLDILEEIWWLENANPVRWREARTKPQ

SEQ ID NO: 19 - protein, 668 aa, Homo sapiens
MAANMYRVGDYVYFENSSSNPYLVRRIEELNKTANGNVEAKVVCLFRRRDISSSLNSLADSNAREFEEESKQPGVSEQQRHQLKHRELFLSRQFESLPATHIRGKCSVTLLNETDILSQYLEKEDCFFYSLVFDPVQKTLLADQGEIRVGCKYQAEIPDRLVEGESDNRNQQKMEMKVWDPDNPLTDRQIDQFLVVARAVGTFARALDCSSSIRQPSLHMSAAAASRDITLFHAMDTLQRNGYDLAKAMSTLVPQGGPVLCRDEMEEWSASEAMLFEEALEKYGKDFNDIRQDFLPWKSLASIVQFYYMWKTTDRYIQQKRLKAAEADSKLKQVYIPTYTKPNPNQIISVGSKPGMNGAGFQKGLTCESCHTTQSAQWYAWGPPNMQCRLCASCWIYWKKYGGLKTPTQLEGATRGTTEPHSRGHLSRPEAQSLSPYTTSANRAKLLAKNRQTFLLQTTKLTRLARRMCRDLLQPRRAARRPYAPINANAIKAECSIRLPKAAKTPLKIHPLVRLPLATIVKDLVAQAPLKPKTPRGTKTPINRNQLSQNRGLGGIMVKRAYETMAGAGVPFSANGRPLASGIRSSSQPAAKRQKLNPADAPNPVVFVATKDTRALRKALTHLEMRRAARRPNLPLKVKPTLIAVRPPVPLPAPSHPASTNEPIVLED

SEQ ID NO: 20 - DNA, 19296 bp, Homo sapiens
ccttcagttcttaaagcgctgcaattcgctgctgcagccatatttcttactctctcggggctggaagcttcctgactgaagatctctctgcacttggggttctttctagaacattttctagtcccccaacaccctttatggcgtatttctttaaaaaaatcacctaaattccataaaatatttttttaaattctatactttctcctagtgtcttcttgacacgtcctccatatttttttaaagaaagtatttggaatattttgaggcaatttttaatatttaaggaatttttctttggaatcatttttggttgacatctctgttttttgtggatcagttttttactcttccactctcttttctatattttgcccatcggggctgcggatacctggttttattattttttctttgcccaacggggccgtggatacctgccttttaattcttttttattcgcccatcggggccgcggatacctgctttttatttttttttccttagcccatcggggtatcggatacctgctgattcccttcccctctgaacccccaacactctggcccatcggggtgacggatatctgctttttaaaaattttctttttttggcccatcggggcttcggatacctgctttttttttttttatttttccttgcccatcggggcctcggatacctgctttaatttttgtttttctggcccatcggggccgcggatacctgctttgatttttttttttcatcgcccatcggtgctttttatggatgaaaaaatgttggttttgtgggttgttgcactctctggaatatctacacttttttttgctgctgatcatttggtggtgtgtgagtgtacctaccgctttggcagagaatgactctgcagttaagctaagggcgtgttcagattgtggaggaaaagtggccgccattttagacttgccgcataactcggcttagggctagtcgtttgtgctaagttaaactagggaggcaagatggatgatagcaggtcaggcagaggaagtcatgtgcattgcatgagctaaacctatctgaatgaattgatttggggcttgttaggagctttgcgtgattgttgtatcgggaggcagtaagaatcatcttttatcagtacaagggactagttaaaaatggaaggttaggaaagactaaggtgcagggcttaaaatggcgattttgacattgcggcattgctcagcatggcgggctgtgctttgttaggttgtccaaaatggcggatccagttctgtcgcagtgttcaagtggcgggaaggccacatcatgatgggcgaggctttgttaagtggttagcatggtggtggacatgtgcggtcacacaggaaaagatggcggctgaaggtcttgccgcagtgtaaaacatggcgggcctctttgtctttgctgtgtgcttttcgtgttgggttttgccgcagggacaatatggcaggcgttgtcatatgtatatcatggcttttgtcacgtggacatcatggcgggcttgccgcattgttaaagatggcgggttttgccgcctagtgccacgcagagcgggagaaaaggtgggatggacagtgctggattgctgcataacccaaccaattagaaatgggggtggaattgatcacagccaattagagcagaagatggaattagactgatgacacactgtccagctactcagcgaagacctgggtgaattagcatggcacttcgcagctgtctttagccagtcaggagaaagaagtggaggggccacgtgtatgtctcccagtgggcggtacaccaggtgttttcaaggtcttttcaaggacatttagcctttccacctctgtcccctcttatttgtcccctcctgtccagtgctgcctcttgcagtgctggatatctggctgtgtggtctgaacctccctccattcctctgtattggtgcctcacctaaggctaagtatacctccccccccaccccccaacccccccaactccccacccccaccccccaccccccacctccccacccccctacccccctacccccctacccccctctggtctgccctgcactgcactgttgccatgggcagtgctccaggcctgcttggtgtggacatggtggtgagccgtggcaaggaccagaatggatcacagatgatcgttggccaacaggtggcagaagaggaattcctgccttcctcaagaggaacacctaccccttggctaatgctggggtcggattttgatttatatttatcttttggatgtcagtcatacagtctgattttgtggtttgctagtgtttgaatttaagtcttaagtgactattatagaaatgtattaagaggctttatttgtagaattcactttaattacatttaatgagtttttgttttgagttccttaaaattccttaaagtttttagcttctcattacaaattccttaacctttttttggcagtagatagtcaaagtcaaatcatttctaatgttttaaaaatgtgctggtcattttctttgaaattgacttaactattttcctttgaagagtctgtagcacagaaacagtaaaaaatttaacttcatgacctaatgtaaaaaagagtgtttgaaggtttacacaggtccaggccttgctttgttcccatccttgatgctgcactaattgactaatcacctacttatcagacaggaaacttgaattgctgtggtctggtgtcctctattcagacttattatattggagtatttcaatttttcgttgtatcctgcctgcctagcatccagttcctccccagccctgctcccagcaaacccctagtctagccccagccctactcccaccccgccccagccctgccccagccccagtcccctaaccccccagccctagccccagtcccagtcctagttcctcagtcccgcccagcttctctcgaaagtcactctaattttcattgattcagtgctcaaaataagttgtccattgcttatcctattatactgggatattccgtttacccttggcattgctgatcttcagtactgactccttgaccattttcagttaatgcatacaatcccatttgtctgtgatctcaggacaaagaatttccttactcggtacgttgaagttagggaatgtcaattgagagctttctatcagagcattattgcccacaatttgagttacttatcattttctcgatcccctgcccttaaaggagaaaccatttctctgtcattgcttctgtagtcacagtcccaattttgagtagtgatcttttcttgtgtactgtgttggccacctaaaactctttgcattgagtaaaattctaattgccaataatcctacccattggattagacagcactctgaaccccatttgcattcagcagggggtcgcagacaacccgtcttttgttggacagttaaaatgctcagtcccaattgtcatagctttgcctattaaacaaaggcaccctactgcgctttttgctgtgcttctggagaatcctgctgttcttggacaattaaagaacaaagtagtaattgctaattgtctcacccattaatcatgaagactaccagtcgcccttgcatttgccttgaggcagcgctgactacctgagatttaagagtttcttaaattattgagtaaaatcccaattatccatagttctgttagttacactatggcctttgcaaacatctttgcataacagcagtgggactgactcattcttagagccccttcccttggaatattaatggatacaatagtaattattcatggttctgcgtaacagagaagacccacttatgtgtatgcctttatcattgctcctagatagtgtgaactacctaccaccttgcattaatatgtaaaacactaattgcccatagtcccactcattagtctaggatgtcctctttgccattgctgctgagttctgactacccaagtttccttctcttaaacagttgatatgcataattgcatatattcatggttctgtgcaataaaaatggattctcaccccatcccaccttctgtgggatgttgctaacgagtgcagattattcaataacagctcttgaacagttaatttgcacagttgcaattgtccagagtcctgtccattagaaagggactctgtatcctatttgcacgctacaatgtgggctgatcacccaaggactcttcttgtgcattgatgttcataattgtatttgtccacgatcttgtgcactaacccttccactccctttgtattccagcaggggacccttactactcaagacctctgtactaggacagtttatgtgcacaatcctaattgattagaactgagtcttttatatcaaggtccctgcatcatctttgctttacatcaagagggtgctggttacctaatgcccctcctccagaaattattgatgtgcaaaatgcaatttccctatctgctgttagtctggggtctcatcccctcatattccttttgtcttacagcagggggtacttgggactgttaatgcgcataattgcaattatggtcttttccattaaattaagatcccaactgctcacaccctcttagcattacagtagagggtgctaatcacaaggacatttcttttgtactgttaatgtgctacttgcatttgtccctcttcctgtgcactaaagaccccactcacttccctagtgttcagcagtggatgacctctagtcaagacctttgcactaggatagttaatgtgaaccatggcaactgatcacaacaatgtctttcagatcagatccattttatcctccttgttttacagcaagggatattaattacctatgttacctttccctgggactatgaatgtgcaaaattccaatgttcatggtctctccctttaaacctatattctaccccttttacattatagaaagggatgctggaaacccagagtccttctcttgggactcttaatgtgtatttctaattatccatgactcttaatgtgcatattttcaattgcctaattgatttcaattgtctaagacatttcaaatgtctaattgattagaactgagtcttttatatcaagctaatatctagcttttatatcaagctaatatcttgacttctcagcatcatagaagggggtactgatttcctaaagtctttcttgaatttctattatgcaaaattgccctgaggccgggtgtggtggctcacacctgtaatcccagcactttgggaggctgaggtgggaagatcccttactgccaggagtttgagaccagcctggccaacattaaaaaaaaaaaaaagtaagacaattgccctggaatcccatccccctcacacctccttggcaaagcagcaggagtgctaactagctagtgcttcttctcttatactgcttaaatgcgcataattagcagtagttgatgtgcccctatgttagagtagaatcccgcttccttgctccatttgcattactgcaggagcttctaactagcctgaattcactctcttggactgttaatgtgcatacttatatttgctgctgtacttttttaccatgtaaggaccccacccactgtatttacatcccagctggaagtacctactacttaagacccttagactagtaaagttagcgtgcataatcttaggtgttatatacacattttcagttgcatacagttgtgccttttatcaggactcctgtacttatcaaagcagagagtgctaatcaatattaagcccttctcttcgaactgtagatggcatgtaattgcagttgtcaatggtccttcaattagacttgggtttctgacctatcacaccctctttgctttattgcatggggtactattcacttaaggcccctttctcaaactgttaatgtgcctaatgacaattacatcagtatccttccttttgaaggacagcatggttggtgacacctaaggccccatttcttggcctcccaatatgtgtgattgtatttgtcgaggttgctatgcactagagaaggaaagtgctcccctcatccccacttttcccttccagcaggaagtgcccaccccataagacccttttatttggagagtctaggtgcacaattgtaagtgaccacaagcatgcatcttggacatttatgtgcgtaatcgcacactgctcattccatgtgaataaggtcctactctccgaccccttttgcaatacagaagggttgctgataacgcagtccccttttcttggcatgttgtgtgtgattataatcgtctgggatcctatgcactagaaaaggagggtcctctccacatacctcagtctcacctttcccttccagcagggagtgcccactccataagactctcacatttggacagtcaaggtgcgtaattgttaagtgaacacaaccatgcaccttagacatggatttgcataactacacacagctcaacctatctgaataaaatcctactctcagaccccttttgcagtacagcaggggtgctgatcaccaaggccctttttcctggcctggtatgcgtgtgattatgtttgtcccggttcctgtgtattagacatggaagcctcccctgccacactccacccccaatcttcctttcccttccggcagggagtgccctctccataagacgcttacgtttggacaatcaaggtgcacagttgtaagtgaccacaggcatacaccttggacattaatgtgcataaccactttgcccattccatctgaataaggtcctactctcagaccccttttgcagtacagcaggggtgctgatcaccaaggccccttttcttggcctgttatgtgcgtgattatatttgtctgggttcctgtgtattagacaaggaagccttccccccgcccccacccccactcccagtcttcctttcccttccagcagggagtgccccctccataagatcattacatttggacaatcaaggtgcacaattataagtgaccacagccatgcaccttggacattattggacattaatgtgcgtaactgcacatggcccatcccatctgaataaggtcctactctcagatgccctttgcagtacagcaggggtactgaatcaccaaggccctttttcttggcctgttatgtgtgtgattatatttatcccagtttctgtgtaatagacatgaaagcctcccctgccacaccccacctccaatcttcctttcccttccaccagggagtgtccactccatatacccttacatttggacaatcaaggtgcacaattgtaagtgagcataggcactcaccttggacatgaatgtgcataactgcacatggcccatcccatctgaataaggtcctactctcagaccctttttgcagtacagcaggggtgctgatcaccaaggccccttttcctggcctgttatgtgtgtgattatatttgttccagttcctgtgtaatagacatggaagcctcccctgccacactccacccccaatcttcctttcccttctggcaggaagtacccgctccataagacccttacatttggacagtcaaggtgcacaattgtatgtgaccacaaccatgcaccttggacataaatgtgtgtaactgcacatggcccatcccatctgaataaggtcctactctcagaccccttttgcagtacagtaggtgtgctgataaccaaggcccctcttcctggcctgttaacgtatgtgattatatttgtctgggttccagtgtataagacatggaagcctcccctgccccaccccaccctcaatcttcctttcccttctggcagggagtgccagctccataagaaccttacatttggacagtcaaggtgcacaattctaagtgaccgcagccatgcaccttggtcaataatgtgtgtaactgcacacggcctatctcatctgaataaggccttactctcagaccccttttgcagtacagcaggggtgctgataaccaaggcccattttcctggcctgttatgtgtgtgattatatttgtccaggtttctgtgtactagacaaggaagcctcctctgccccatcccatctacgcataatctttcttttcctcccagcagggagtgctcactccataagacccttacatttggacaatcaaggtgcacaattgtaagtgaccacaaccatgcatcttggaaatttatgtgcataactgcacatggcttatcctatttgaataaagtcctactctcagaccccctttgcagtatagctggggtgctgatcactgaggcctctttgcttggcttgtctatattcttgtgtactagataagggcaccttctcatggactccctttgcttttcaacaaggagtacccactactttttaagattcttatatttgtccaaagtacatggttttaattgaccacaacaatgtcccttggacattaatgtatgtaatcaccacatggttcatcctaattaaacaaagttctaccttctcaccctccatttgcagtataccagggttgctgaccccctaagtccccttttcttggcttgttgacatgcataattgcatttatgttggttcttgtgccctagacaaggatgccccacctcttttcaatagtgggtgcccactccttatgatctttacatttgaacagttaatgtgaataattgcagttgtccacaaccctatcacttctaggaccattatacctcttttgcattactgtggggtatactgtttccctccaaggccccttctggtggactatcaacatataattgaaattttcttttgtctttgtcagtagattaaggtcataccccatcacctttcctttgtagtacaacagggtgtcctgatcaaccaaagtcctgttgttttggactgttaatatgtgcaattacatttgctcctgatctgtgcactagataaggatcctacctactttcttagtgtttttagcaggtagtgcccactactcaagactgtcacttggaatgttcatgtgcacaaactcaattctctaagcatgttcctgtaccacctttgctttagagcagggggatgatattcactaagtgccccttcttttggacttaatatgcattaatgcaattgtccacctcttcttttagactaagagttgatctccacatattccccttgcatcaggggcatgttaattatgaatgaacccttttcttttaatattaatgtcataattgtatttgtggacctgtgtaggagaaaaagaccctatgttcctcccattaccctttggattgctgctgagaagtgttaactactcataatctcagctcttggacaattaatagcattaataacaattatcaagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaacatttattatcattattgaacctacaacagagatctatgtgtagatttacaaagcctacagttctatacagataggaatgaactattggcttactgaatggtgattactttctgtggggctcggaactacatgccctaggatataaaaatgatgttatcattatagagtgctcacagaaggaaatgaagtaatataggtgtgagatccagaccaaaagtcatttaacaagtttattcagtgatgaaaacatgggacaaatggactaatataaggcagtgtactaagctgagtagagagataaagtcctgtccagaagatacatgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagattaaaaaaaaaaaaaaaaagaaagaaaaatgcaagtttctttcaaaataaagagacatttttcctagtttcaggaatcccccaaatcacttcctcattggcttagtttaaagccaggagactgataaaagggctcagggtttgttctttaattcattaactaaacattctgcttttattacagttaaatggttcaagatgtaacaactagttttaaaggtatttgctcattggtctggcttagagacaggaagacatatgagcaataaaaaaaagattcttttgcatttaccaatttagtaaaaatttattaaaactgaataaagtgctgttcttaagtgcttgaaagacgtaaaccaaagtgcactttatctcatttatcttatggtggaaacacaggaacaaattctctaagagactgtgtttctttagttgagaagaaacttcattgagtagctgtgatatgttcgatactaaggaaaaactaaacagatcacctttgacatgcgttgtagagtgggaataagagagggctttttattttttcgttcatacgagtattgatgaagatgatactaaatgctaaatgaaatatatctgctccaaaaggcatttattctgacttggagatgcaacaaaaacacaaaaatggaatgaagtgatactcttcatcaaacagaagtgactgttatctcaaccattttgttaaatcctaaacagaaaacaaaaaaaatcatgacgaaaagacacttgcttattaattggcttggaaagtagaatataggagaaaggttactgtttattttttttcatgtattcattcattctacaaatatattcgggtgccaataggtacttggtataaggtttttggccccagagacatgggaaaaaaatgcatgccttcccagagaatgcctaatactttccttttggcttgttttcttgttaggggcatggcttagtccctaaataacattgtgtggtttaattcctactccgtatctcttctaccactctggccactacgataagcaggtagctgggttttgtagtgagcttgctccttaagttacaggaactctccttataatagacacttcattttcctagtccatccctcatgaaaaatgactgaccactgctgggcagcaggagggatgatgaccaactaattcccaaaccccagtctcattggtaccagccttggggaaccacctacacttgagccacaattggttttgaagtgcatttacaaggtttgtctattttcagttctttactttttacatgctgacacatacatacactgcctaaatagatctctttcagaaacaatcctcagataacgcatagcaaaatggagatggagacatgatttctcatgcaacagcttctctaattataccttagaaatgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtgaaggaaaaggtcaaacctgttttaagggcaacctgcctttgttctgaattggtcttaagaacattaccagctccaggtttaaattgttcagtttcatgcagttccaatagctgatcattgttgagatgaggacaaaatcctttgtcctcactagtttgctttacatttttgaaaagtattatttttgtccaagtgcttatcaactaaaccttgtgttaggtaagaatggaatttattaagtgaatcagtgtgacccttcttgtcataagattatcttaaagctgaagccaaaatatgcttcaaaagaagaggactttattgttcattgtagttcatacattcaaagcatctgaactgtagtttctatagcaagccaattacatccataagtggagaaggaaatagataaatgtcaaagtatgattggtggagggagcaaggttgaagataatctggggttgaaattttctagttttcattctgtacatttttagttagacatcagatttgaaatattaatgtttacctttcaatgtgtggtatcagctggactcagtaacacccctttcttcagctggggatggggaatggattattggaaaatggaaagaagaaagtaactaaaagccttcctttcacagtttctggcatcactaccactactgattaaacaagaataagagaacattttatcatcatctgctttattcacataaatgaagttgtgatgaataaatctgcttttatgcagacacaaggaattaagtggcttcgtcattgtccttctacctcaaagataatttattccaaaagctaagataaatggaagactcttgaacttgtgaactgatgtgaaatgcagaatctcttttgagtctttgctgtttggaagattgaaaaatattgttcagcatgggtgaccaccagaaagtaatcttaagccatctagatgtcacaattgaaacaaactggggagttggttgctattgtaaaataaaatatactgttttgaaaactttgaaaaaaaaaaaaaaaa

SEQ ID NO: 21 - DNA, 25 bp, Artificial sequence
  Single strand DNA oligonucleotide
tgtttttttgtttattggggttgtg

SEQ ID NO: 22 - DNA, 24 bp, Artificial sequence
  Single strand DNA oligonucleotide
taaattttaaattaattaaattat

SEQ ID NO: 23 - DNA, 29 bp, Artificial sequence
  Single strand DNA oligonucleotide
tgttttagaaagaattttaagtgtagaga

SEQ ID NO: 24 - DNA, 20 bp, Artificial sequence
  Single strand DNA oligonucleotide
agggagcagtttgccctact

SEQ ID NO: 25 - DNA, 20 bp, Artificial sequence
  Single strand DNA oligonucleotide
cacatgcagcgtggtatctt

SEQ ID NO: 26 - DNA, 8199 bp, Homo sapiens
ttgccctactagctcctcggacagctgtaaagaagagtctctggctctttagaatactgtaagtactacttcgtagctattaagtaatctttttcctattctattttctttctcttagatgccacctatagaaaagtcagagggtccagtaagtttctttccttcttcccacctcatctgcaatatatatatatagagagagaaatagatacatacatacatgcataaatacacatatgtgagttaaccagcagaactgtagaattaatattgtggacccagctctatgctaggttacactgataacctgggtaggaatgatatcatcctatataatttcattcctgagatgattttatcgttgaggagctaatgtgagcacatttgaaataactttagaaaataataagtgctgttttgtgtgaatcataagtagtagttttaggaagggaacccacaaggatttgaagttgatagaataaacttaaggaagtgggtttgctttttctctttaagccaagataggattaatattgcagccatctggatagtccagttggtttattttaatttcatttgttttttacctcttttggagccatggaaagagatgaaagggatagagcatagccattgtgtttggctatttgcgaaggttggcaaattagtgattgctaaatctcataagcttgagtattttaaagttcagagattgagggcataaatctaatacttcggctccttccacaattttactacatttctgcccaagaacagatgaccatggataatgcatatcgtagatactttttaagtttggaacctttttgccaagagggtagtggagaagtgaagtcaaaaccttgaccttccttgcctactttatgctgtagtttatataccttctttcctcccacctttcgtaaagctaaaagaagcttagcctccttaatgttttccagctgacaaaatattgtttaacataacattcgaaactttttttctggtgcacattcatgcatcacagcaggagcaacaagaaccatataagtgaactggcttcacttatagcccgttttaattcatatccatatttcctcagggcttgtttccatgcctcccagccccactccatatgcttaacaacattgtctggctgactgagggttatatacatcatggtcttgaaccttcttggaaacatggtctgtgccattgtttctcaaacccaagtaatgcttcatgatgaaacaccttctaaaggaacaaaattttctgagatcctaaaaaaatgtgttttgaggaacactgacttaacaaagatatttgaaatgtaaatatgttttccaatttcacgttgtctttgtcaaagatgtgttttatataacttatgtagaacttggggatccattagaatatattcacaaatccccagggttatcaccccaatttgagaaaccctggtctatgcttatgaaatcttctattggtaattaaattgtcattcattgtcaacatacaattataattattattggaatttgttttaaatgaatgaatttggaggtgattctgtaccttaagtcaagaggaaggatggcttgattttaggtggattgattatactagatagcatccaaaggtgaatcttgaagctgtatttaaattcattgcttgaaataatttccacccttaagaaaaatctctagcaattgtaaaaagggatgctctggaaatgtgggcatcttcaaaatagagataattcttgtgttagttcaacaaatattattgtaccaggtgctggaataaatagcaaaaccaaagacaggatttatatcaaggaatttgctttcttatggaggatgcagaaggaaatcattatggttttgggcagaaatgcttagactttagtcctggctctgagtttggttcagatcaccatcaatctgaccatctcgagactgctagtgaaataagataggggcttatatcaaatacctaaatccctgaaaatgacattttgtgatttggaaaattttcaaaagtctaatgaaggaaacttttttggcatttctttaaatgattattgtcatttcttttctgacttttccctttataaaaccttaacatgtaggattggaggaagttttctgaccattttctcatatcctctttcagctttatctttctgtaacttccatttctctagccacctccctaaattacagaagactgtgagacccagggctgctgtgattaggcattcataatttcttttcagggtgtttgtgccctgattatcaaatgtacagcttgaagggagttcatgtcttaaagtaatgaattaagagttgacctttgttgactgctaaaatattcttatatgtgaaagcatcctggaaaaatacgttaccagcttaaagagaaagaaactaatgattatatctgaactgagctaatgcctcttctcttcccccaaaccttatcagtttggatggcaaagagtaatgatgtgtcagttaaacagagctaatgccttcctctgccttgtcttaaagactggattgggagaaaattgatattctcactaccatattttgggctgtaggcaagtagcattttacacaggtttccttcaaaaatccaactcaagttggagctcatgtatttaagacatagctggcctgctgaatttaacaagttaaacttcagtggccatgtacagttatatatcactatatatatgtgtattaggctgtcgagttggtcatgtttttgttggtgacttaggctttacttgatagctcttccttgacctttccaaattgagtactgatacatggagcttgggcttcttctgcatcttatacaaatgagtttggtaaagaagcctctcctttactgttttgatgtttatattagaaataacttttgattattttttttcatgttaggatgagaaactgaaacaaaatgtaaatttgaccggtgctagacttcttaaattatgggtagacttaaagtattattttccttaaccaattagaatgctagtcttctagtgttcccggaaacatgagaggttatgcagtagacccaagcaataccctcttattacataatcaagtgcgtataagaatttaaaaatagggatatgactggaacatcactgtactttaccaggtcccattataaaattatctatgttactttacccatagctttgaaaactagtggcatagtatattttatagtatgctgttagtgtgattggcattgaacagtgatgggatataatcactctacaatctatatgttattaaagttttccagccttatagatctcccttgactgaaaattagctactaacttacgacttattttttacagcagattgactaggtctttccaggaaatctgttgatgtacaaaaacaaagtttaattgctaatgtttttttaaaaaataactttttgatattacggatacctggttatttgggccttgtatattttaacatcaaaattacctattataaatccatataaacagaaaagaaagagagtaagtctttagatcagatctgcaaacaatgatggtacgtactgtagaaaaatctggaacatagacttaccagttcttaggttccattttgcttgctttttaaaaactgtgtcttataagtcttcagcaactggttgggagatttttagaaaaaataaccttttaatgttagaacagtgtagagatttacagaatgattctgaagatagagtttctgtgtacttcacacccagtttttcccagtgttaacattttacattagtttggtacatttgtcacaacaaaccaatattgatacattattattaactagagtccatattttattcagatttccttagtttttccttaatgttctttttgtgttccaggatcccattgaagataccacgctgcatgtgtccttagtagtcatgtctccttaggctcctcttggtaatgacagtttctcagactctttgtttttgatgaacttcacagttttgaggactaatggtccagtattctatagaatgtctctctattggaatttgtctgatgttcttctcatgactagattgggtttatgagtgtttaggaggaagaccacaaaggtagagtgccattcttatcacttatcaagagtacatactatcaacatgacttatcactgtttatgttatccttaatcacctgtctgaggtactatttgtcaggtttctccagcgtaaaattagtctttatttctccatttccctactatactgttcacataggaagtcactatgtgcagccagcacttaaggaatgggaaattaccttccacctcattgagggcagagtatttacataaattatttggaattcttttgcacaggatgtcttttctccacaatgtattgtgtttattcagtcatttatatcagtatgatctcagggatattttatactctgggttataatacagtattactttattctgttgttcaaattgttccagctttggccattgggaggtctttcatttggctttgatataaccccatgaatgtgggttttttgtttgagcactttcttatttttggaactacaacatgcttcagactcatttgcatatctcctgcctggacctaaaatgatgtatttctgcaaggagccttgatactttttattggagagtaatattagaaatcaagaagtgaatgctaggtgcgctcattactactggagtgtcattccttcaagaccttttcagttgacaagagcaaggagatatatatttgcattctaacgtgtgtatatgcacatagctataaatatatataaccatctgtatctatattaaactaaatgtgtttatacctacgtctccaactctaatcattgccacatggatcattatagtctcacctccttgcttatctgttacctcccatttctacagtgagaaacctggcttggttgggaaatttttctgttaatattacggtagtgagtgtttgacatttgcttctatggttaagtttagggagagtttagctgtagggtattcttgaaactagaaatgacccttctgccctaaatgtttctgccagttttgaaacgtaaaataggttgcagaaacaaactttatcttaagaaccagaatttacttcaatccacattttgacattgattttcagattaaattattctgatatcgccaggtaagctgttccttgggtatgcatttcttctttccgtttttttctaagagctaaaggaccctgagaacactggaggtgggaaaggaagggaaaggcatgttcacacgtgggataggaaaggttcatttactgacctccagctagccttccaaagtgcctatttaagacccaaggagtagatgtcttccttggcaattgtaacccaaatataatttttaacctttcaattttagtcaagaaagttggtgtgctgttacaaaaagtgccctgattaacagcattgtcatgtgcattgcatattaatcagcaatttaaaataacatgaaattatgttgagtataattttaatattttatattagatattagtttgagacagtgtttctcaagtctgtataataagtttgatagtagggaggttttctctcaagaaaagaattattcagtgtgcacctacataatcactgcttagattctacaattaatattttgctatatttgattaaacgttttctgtaaaagaaaaatattattatgtactatttaggtttatgggaataattgttaagttaaagtgtatgaacaaacctggaatgaaatctgtttgcctacatctataatacaactataaaacatagcagatgtacaaattagtagttaatagataactaaaatgcaaatatggcactactattatagtattatagtttcttttgagtggcgtgtctgtaatatcacatgctgtgttgatgcacttcaccaaactgctgttttcaaactgctttaaatcctgccattatagcacatagcaatgctatttcactttcatttggcacaaaacacatttatatattgtttgcttctcttcttttctgtaatccccaggcaacaaaactagaacatttgccactaatctggcaacgtggtcctatattatgaagtagtcatatagctgatctaaactatccttacagtgaaatgagagtattgtgaaagttttgtagaaagctccccatatgtcctgagaatctatgcacagaccccacagttaaaagacctttgaattgtgggaagacatgggtttaagtatcacttggttaccttctatttgtgtaacattgaggtagtttcatcttctgggttcccagtttccttagagaatgaaaatgttgaattatgtgatttttttttttttttgagacggagttttgctctttcgcccaggctggagtgaagtagcacgatctcgactcactgcaacctccttcccccatgatcaagcaattctcctgcctcagcctcccaagtagctgggattacaggcacccgccccccaccccccgcccccagctaatgtttgtatttttagtacagatggagttttgccgtgttggccaggctggtctcgaacttctgacctcaggtgatccactcgccttggcctcccaaagtgctaggattacaggcatgagccactgcgcctggcctatgtgattattaatatcacgtctagctgtgacaattctgtctgatgctggagtatttgaaccagatggctggctgtgccactcagttattctctccataagactttgatattttgttggtctgcaagatgacggattctcaaaattcttgtcagtgaatattgaaccctagtgaaatgtatggttctgtatcagttccaaaatgtaaccactttctctagccttagattcccagttccaaaatgtaaccattttctctagccttagattcccgttaagggaaagggaatgctctttgagtatgtcatcaccatagtaacaggcaaaactagagggctttgatgctaaagcaagatactccataaatatgcttaagaagacttggggagactggaatagttgttcccttttagatgccagtgtataaatgaatttgagctaggatccgtttatttaaaatttctttaggtgtatttgcttgcatatggagtgcacatttactctcattaatggagttttaggaagcagtagagtaaatgcataaacatgtatgaaccgccatgtttaactggaagcctgcatttggaagtcaagtatctaatcttagattaaattaggatggggaaggatgttggcaagagattttgaagcttgttctgcttatattgagaacatcatagaacagtttggcctttttaaagctagagaatagtgttgaataagtgatgttccatatattcctgtttgacattgacataaaggtttcctcatgatacagtaatccctgatcagggatctggaagcctgtattcatttaaggtactcaggtttaacatactgggtgcttttcacaccatactatacagtaccatgcaaagtgctttcaagactgcaaatttggcttagatcccctttagtgagctcctatgctatagtaaaggtagatagccaattattaaaaacagtcaagacaattgcacctctaagcagtagtagcagttgccacaccaccttgaatcttgaagtattttcagcaacaggatgaccattagccacaaatttagtgtcagcccttaaggtcggtattggtttgacccatattttcatgtagttctttttcttcacttgtctaatcttcccgtgtactgccagggcttgtcattagaggactttagggagaccaagcaggctagaaagtagagacaggagatacctatgtctaatgcttcagtttatacttcctaggtttttttcattggggtttttgtaactcttttggtatcctaccggtgctttggtagcctactgaaccctgtctttcttcttaaggacattctgagcatgtgagacctgaggactgcaaacagctataagaggctccaaattaatcatatctttccctttgagaatctggccaagctccagctaatctacttggatgggttgccagctatctggagaaa

SEQ ID NO: 27 - DNA, 3578 bp, Homo sapiens
aatttcaccttttttctgagtctggcctcctttctgctgtttctactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtgtaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaatagtgaatgtgctttgtaaactgtaaagcacttgtattctactgtgataagcgttgtggatacaaagaaaggagcaagcataaaaaagtgctctttcaaaaggatatagtactatgcagacacaaggaattgtttgataaatgaataaattatatgtatatttgaggccaatttgtgtttgctgctctggtaattttgagtaaaaatgcagtattccaggtatcagaaacgaaaacacatggaaactgcttttaaactttaaaatatactgaaaacataagggactaagcttgttgtggtcacctataatgtgccagataccatgctgggtgctagagctaccaaagggggaaaagtattctcatagaacaaaaaatttcagaaaggtgcatattaaagtgctttgtaaactaaagcatgatacaaatgtcaatgggctacatatttatgaatgaatgaatggatgaatgaatattaagtgcctcttacataccagctattttgggtactgtaaaatacaagattaattctcctatgtaataagaggaaagtttatcctctatactattcagatgtaaggaatgatatattgcttaattttaaacaatcaagactttactggtgaggttaagttaaattattactgatacatttttccaggtaaccaggaaagagctagtatgaggaaatgaagtaatagatgtgagatccagaccgaaagtcacttaattcagcttgcgaatgtgctttctaaattataaagcacttgtaaatgaaaaatttgatgctttctgtatgaataaaactttctgtaagctaggtattgtctctacaaaattctcattgtatagttaaaccacagtgagaagggttctataagtagttatacaaaccaagggtttaaatacctgttaaatagatcaattttgattgcctactatgtgaactcactgttaaaggcactgaaaatttatcatatttcatttagccacagccaaaaataaggcaatacctatgttagcattttgtgaactctaaggcaccatataaatgtaactgttgattttctcacttggtgctgggtactaggtttataaaattgtatgatagttattatattgtgcaaataaagtaggaaaatttgaataacaatgattatcttttgaatacgcatacgcaagggattggttgtctgaagaatgccactatagtagttatctattgtgtgccaatctcattgctaggcattggggatgcaaagataaaccatctttattgtgtcttgggtagcagaagaaaatatgtgtaaaatcaatttataatttgtaaactgccacccatatataagctatatctgctgaatgatcattgattactcttatccttagagataacaactgggggcacaaa

SEQ ID NO: 28 - protein, 390 aa, Homo sapiens
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 29 - protein, 288 aa, Homo sapiens
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 30 - DNA, 3808 bp, Homo sapiens
cttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcagtacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggccttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccccccatcccctactgtgacttgctttagggtgtcagggtccaggctgcaggggctgggccaatttgtggagaggccgggtgcctttctgtcttgattccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagatgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactcttggctggcaaaaaaaaaaaaaaaaaa

SEQ ID NO: 31 - DNA, 2217 bp, Homo sapiens
ccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggaaaaaaaaaaaaaaaaaa

SEQ ID NO: 32 - DNA, 6774 bp, Homo sapiens
cggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaatttatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctcattttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctccc

SEQ ID NO: 33 - protein, 379 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 34 - protein, 357 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEVGQSPAAVGLGAGEQGGT

SEQ ID NO: 35 - protein, 335 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILALDLLDRMLTFNPNKRITVEEALAHPYLEQYYDPTDEPVAEEPFTFAMELDDLPKERLKELIFQETARFQPGVLEAP

SEQ ID NO: 36 - protein, 366 aa, Homo sapiens
PRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 37 - protein, 360 aa, Homo sapiens [sequence omitted]

SEQ ID NO: 38 - protein, 360 aa, Homo sapiens [sequence omitted]

SEQ ID NO: 39 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 40 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 41 - protein, 297 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLGKLTIYPHLMDIELVMI

SEQ ID NO: 42 - protein, 307 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESLSTCWRRCLYWTQIRELQRPKPLHMPTLLSTTILMMNQWPILMISPLKAGTSL

SEQ ID NO: 43 - protein, 364 aa, Homo sapiens
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 44 - protein, 367 aa, Homo sapiens
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 45 - protein, 365 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 46 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 47 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 48 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 49 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 50 - protein, 1354 aa, Homo sapiens
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTS

SEQ ID NO: 51 - protein, 1388 aa, Homo sapiens
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 52 - RNA, 25 nt, Artificial sequence
  SiRNA oligonucleotide
aggucaagggcaagcccgaccugaa

SEQ ID NO: 53 - RNA, 25 nt, Artificial sequence
  SiRNA oligonucleotide
uucaggucgggcuugcccuugaccu

SEQ ID NO: 54 - protein, 360 aa, Homo sapiens; identical to SEQ ID NO: 9

SEQ ID NO: 55 - DNA, 1411 bp, Homo sapiens
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 56 - protein, 317 aa, Homo sapiens; identical to SEQ ID NO: 10

SEQ ID NO: 57 - DNA, 2520 bp, Homo sapiens
ggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaa

SEQ ID NO: 58 - protein, 479 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 59 - DNA, 2949 bp, Homo sapiens
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 60 - protein, 454 aa, Homo sapiens
MDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 61 - DNA, 2379 bp, Homo sapiens
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaa

SEQ ID NO: 62 - DNA, 5489 bp, Artificial sequence
  OSKM expression cassette: OCT4-F2A-KLF4-IRES-SOX2-E2A SEQUENCE
atggctggacacctggcttcagacttcgccttctcacccccaccaggtgggggtgatgggtcagcagggctggagccgggctgggtggatcctcgaacctggctaagcttccaagggcctccaggtgggcctggaatcggaccaggctcagaggtattggggatctccccatgtccgcccgcatacgagttctgcggagggatggcatactgtggacctcaggttggactgggcctagtcccccaagttggcgtggagactttgcagcctgagggccaggcaggagcacgagtggaaagcaactcagagggaacctcctctgagccctgtgccgaccgccccaatgccgtgaagttggagaaggtggaaccaactcccgaggagtcccaggacatgaaagccctgcagaaggagctagaacagtttgccaagctgctgaagcagaagaggatcaccttggggtacacccaggccgacgtggggctcaccctgggcgttctctttggaaaggtgttcagccagaccaccatctgtcgcttcgaggccttgcagctcagccttaagaacatgtgtaagctgcggcccctgctggagaagtgggtggaggaagccgacaacaatgagaaccttcaggagatatgcaaatcggagaccctggtgcaggcccggaagagaaagcgaactagcattgagaaccgtgtgaggtggagtctggagaccatgtttctgaagtgcccgaagccctccctacagcagatcactcacatcgccaatcagcttgggctagagaaggatgtggttcgagtatggttctgtaaccggcgccagaagggcaaaagatcaagtattgagtattcccaacgagaagagtatgaggctacagggacacctttcccagggggggctgtatcctttcctctgcccccaggtccccactttggcaccccaggctatggaagcccccacttcaccacactctactcagtcccttttcctgagggcgaggcctttccctctgttcccgtcactgctctgggctctcccatgcattcaaacggaagtggcgtgaaacagactttgaattttgaccttctcaagttggcgggagacgtggagtccaacccagggcccatggctgtcagcgacgctctgctcccgtccttctccacgttcgcgtccggcccggcgggaagggagaagacactgcgtccagcaggtgccccgactaaccgttggcgtgaggaactctctcacatgaagcgacttcccccacttcccggccgcccctacgacctggcggcgacggtggccacagacctggagagtggcggagctggtgcagcttgcagcagtaacaacccggccctcctagcccggagggagaccgaggagttcaacgacctcctggacctagactttatcctttccaactcgctaacccaccaggaatcggtggccgccaccgtgaccacctcggcgtcagcttcatcctcgtcttccccagcgagcagcggccctgccagcgcgccctccacctgcagcttcagctatccgatccgggccgggggtgacccgggcgtggctgccagcaacacaggtggagggctcctctacagccgagaatctgcgccacctcccacggcccccttcaacctggcggacatcaatgacgtgagcccctcgggcggcttcgtggctgagctcctgcggccggagttggacccagtatacattccgccacagcagcctcagccgccaggtggcgggctgatgggcaagtttgtgctgaaggcgtctctgaccacccctggcagcgagtacagcagcccttcggtcatcagtgttagcaaaggaagcccagacggcagccaccccgtggtagtggcgccctacagcggtggcccgccgcgcatgtgccccaagattaagcaagaggcggtcccgtcctgcacggtcagccggtccctagaggcccatttgagcgctggaccccagctcagcaacggccaccggcccaacacacacgacttccccctggggcggcagctccccaccaggactacccctacactgagtcccgaggaactgctgaacagcagggactgtcaccctggcctgcctcttcccccaggattccatccccatccggggcccaactaccctcctttcctgccagaccagatgcagtcacaagtcccctctctccattatcaagagctcatgccaccgggttcctgcctgccagaggagcccaagccaaagaggggaagaaggtcgtggccccggaaaagaacagccacccacacttgtgactatgcaggctgtggcaaaacctataccaagagttctcatctcaaggcacacctgcgaactcacacaggcgagaaaccttaccactgtgactgggacggctgtgggtggaaattcgcccgctccgatgaactgaccaggcactaccgcaaacacacagggcaccggccctttcagtgccagaagtgtgacagggccttttccaggtcggaccaccttgccttacacatgaagaggcacttttaaagatccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacacatatgatgtataacatgatggagacggagctgaagccgccgggcccgcagcaagcttcggggggcggcggcggaggaggcaacgccacggcggcggcgaccggcggcaaccagaagaacagcccggaccgcgtcaagaggcccatgaacgccttcatggtatggtcccgggggcagcggcgtaagatggcccaggagaaccccaagatgcacaactcggagatcagcaagcgcctgggcgcggagtggaaacttttgtccgagaccgagaagcggccgttcatcgacgaggccaagcggctgcgcgctctgcacatgaaggagcacccggattataaataccggccgcggcggaaaaccaagacgctcatgaagaaggataagtacacgcttcccggaggcttgctggcccccggcgggaacagcatggcgagcggggttggggtgggcgccggcctgggtgcgggcgtgaaccagcgcatggacagctacgcgcacatgaacggctggagcaacggcagctacagcatgatgcaggagcagctgggctacccgcagcacccgggcctcaacgctcacggcgcggcacagatgcaaccgatgcaccgctacgacgtcagcgccctgcagtacaactccatgaccagctcgcagacctacatgaacggctcgcccacctacagcatgtcctactcgcagcagggcacccccggtatggcgctgggctccatgggctctgtggtcaagtccgaggccagctccagcccccccgtggttacctcttcctcccactccagggcgccctgccaggccggggacctccgggacatgatcagcatgtacctccccggcgccgaggtgccggagcccgctgcgcccagtagactgcacatggcccagcactaccagagcggcccggtgcccggcacggccattaacggcacactgcccctgtcgcacatgggtagtgggcaatgtactaactacgctttgttgaaactcgctggcgatgttgaaagtaaccccggtcctatgcccctcaacgtgaacttcaccaacaggaactatgacctcgactacgactccgtacagccctatttcatctgcgacgaggaagagaatttctatcaccagcaacagcagagcgagctgcagccgcccgcgcccagtgaggatatctggaagaaattcgagctgcttcccaccccgcccctgtccccgagccgccgctccgggctctgctctccatcctatgttgcggtcgctacgtccttctccccaagggaagacgatgacggcggcggtggcaacttctccaccgccgatcagctggagatgatgaccgagttacttggaggagacatggtgaaccagagcttcatctgcgatcctgacgacgagaccttcatcaagaacatcatcatccaggactgtatgtggagcggtttctcagccgctgccaagctggtctcggagaagctggcctcctaccaggctgcgcgcaaagacagcaccagcctgagccccgcccgcgggcacagcgtctgctccacctccagcctgtacctgcaggacctcaccgccgccgcgtccgagtgcattgacccctcagtggtctttccctacccgctcaacgacagcagctcgcccaaatcctgtacctcgtccgattccacggccttctctccttcctcggactcgctgctgtcctccgagtcctccccacgggccagccctgagcccctagtgctgcatgaggagacaccgcccaccaccagcagcgactctgaagaagagcaagaagatgaggaagaaattgatgtggtgtctgtggagaagaggcaaacccctgccaagaggtcggagtcgggctcatctccatcccgaggccacagcaaacctccgcacagcccactggtcctcaagaggtgccacgtctccactcaccagcacaactacgccgcacccccctccacaaggaaggactatccagctgccaagagggccaagttggacagtggcagggtcctgaagcagatcagcaacaaccgcaagtgctccagccccaggtcctcagacacggaggaaaacgacaagaggcggacacacaacgtcttggaacgtcagaggaggaacgagctgaagcgcagcttttttgccctgcgtgaccagatccctgaattggaaaacaacgaaaaggcccccaaggtagtgatcctcaaaaaagccaccgcctacatcctgtccattcaagcagacgagcacaagctcacctctgaaaaggacttattgaggaaacgacgagaacagttgaaacacaaactcgaacagcttcgaaactctggtgcataa

SEQ ID NO: 63 - DNA, 58 bp, Artificial sequence
  Single strand DNA oligonucleotide
ccggctaagtggattgagtgcctttctcgagaaaggcactcaatccacttagtttttg

SEQ ID NO: 64 - DNA, 58 bp, Artificial sequence
  Single strand DNA oligonucleotide
aattcaaaaactaagtggattgagtgcctttctcgagaaaggcactcaatccacttag

SEQ ID NO: 65 - DNA, 58 bp, Artificial sequence
  Single strand DNA oligonucleotide
ccgggcgctatgattcttccaaccactcgagtggttggaagaatcatagcgctttttg

SEQ ID NO: 66 - DNA, 58 bp, Artificial sequence
  Single strand DNA oligonucleotide
aattcaaaaagcgctatgattcttccaaccactcgagtggttggaagaatcatagcgc

SEQ ID NO: 67 - DNA, 26 bp, Artificial sequence
  Single strand DNA oligonucleotide
acaactaacctaaaccaaattataca

SEQ ID NO: 68 - DNA, 25 bp, Artificial sequence
  Single strand DNA oligonucleotide
tgtttttttgtttatcggggtcgcg

SEQ ID NO: 69 - DNA, 28 bp, Artificial sequence
  Single strand DNA oligonucleotide
cgaattatacgacaaatctaaaataacg

SEQ ID NO: 70 - DNA, 203 bp, Artificial sequence
  203bp amplicon covering human XIST transcription start site
gggtaaattttgaaccaaccaaatcacaaagatgtccggctttcaatcttctaggccacgcctcttatgctctctccgccctcagcccccccttcagttcttaaagcgctgcaattcgctgctgcagccatatttcttactctctcggggctggaagcttcctgactgaagatctgttctagaaagaaccccaagtgcagaga

SEQ ID NO: 71 - DNA, 1902 bp, Homo sapiens
atgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatag

SEQ ID NO: 72 - DNA, 20 bp, Artificial sequence
  Single strand DNA oligonucleotide
cagggctgaagagaagatgg

SEQ ID NO: 73 - DNA, 19 bp, Artificial sequence
  Single strand DNA oligonucleotide
acaggaggtgggaatctga

SEQ ID NO: 74 - DNA, 30 bp, Artificial sequence; identical to SEQ ID NO: 1
  Single strand DNA oligonucleotide

SEQ ID NO: 75 - DNA, 25 bp, Artificial sequence
  Single strand DNA oligonucleotide
ctcgagtccacagacctctggcact

SEQ ID NO: 76 - DNA, 35 bp, Artificial sequence; identical to SEQ ID NO: 3
  Single strand DNA oligonucleotide

SEQ ID NO: 77 - DNA, 25 bp, Artificial sequence
  Single strand DNA oligonucleotide
ctcgagctgaggctcatgctgctgg

SEQ ID NO: 78 - DNA, 20 bp, Artificial sequence
  Single strand DNA oligonucleotide
agggagcagtttgccctact

SEQ ID NO: 79 - DNA, 20 bp, Artificial sequence
  Single strand DNA oligonucleotide
cacatgcagcgtggtatctt

SEQ ID NO: 80 - DNA, 20 bp, Artificial sequence
  Single strand DNA oligonucleotide
agtgattctcctgcctcagc

SEQ ID NO: 81 - DNA, 20 bp, Artificial sequence
  Single strand DNA oligonucleotide
cttctgcttcaggagcttgg

SEQ ID NO: 82 - DNA, 20 bp, Artificial sequence
  Single strand DNA oligonucleotide
ggaatgggaggacaggattt

SEQ ID NO: 83 - DNA, 20 bp, Artificial sequence
  Single strand DNA oligonucleotide
aacagccggagcagaagata

SEQ ID NO: 84 - DNA, 20 bp, Artificial sequence
  Single strand DNA oligonucleotide
aaggatgttgaacgggcaga

SEQ ID NO: 85 - DNA, 18 bp, Artificial sequence
  Single strand DNA oligonucleotide
tccgttggaactgatgga

SEQ ID NO: 86 - DNA, 21 bp, Artificial sequence
  Single strand DNA oligonucleotide
tgacactggcaaaacaatgca

SEQ ID NO: 87 - DNA, 21 bp, Artificial sequence
  Single strand DNA oligonucleotide
ggtccttttcaccagcaagct

SEQ ID NO: 88 - DNA, 20 bp, Artificial sequence
  Single strand DNA oligonucleotide
cgccaccaaactgagatgat

SEQ ID NO: 89 - DNA, 20 bp, Artificial sequence
  Single strand DNA oligonucleotide
cacattgtagtgggcagtgg

SEQ ID NO: 90 - DNA, 20 bp, Artificial sequence
  Single strand DNA oligonucleotide
cagtcgctacatcaccatcc

SEQ ID NO: 91 - DNA, 20 bp, Artificial sequence
  Single strand DNA oligonucleotide
tttcctctcctttgctctgc

SEQ ID NO: 92 - DNA, 19 bp, Artificial sequence
  Single strand DNA oligonucleotide
aactcaagaaggcggatgg

SEQ ID NO: 93 - DNA, 19 bp, Artificial sequence
  Single strand DNA oligonucleotide
cggtgcgtcctttaatcct

SEQ ID NO: 94 - DNA, 20 bp, Artificial sequence
  Single strand DNA oligonucleotide
cgcctcggctacaacaacta

SEQ ID NO: 95 - DNA, 20 bp, Artificial sequence
  Single strand DNA oligonucleotide
cgcctcggctacaacaacta

SEQ ID NO: 96 - DNA, 20 bp, Artificial sequence
  Single strand DNA oligonucleotide
aaacgtgctgctctacgaca

SEQ ID NO: 97 - DNA, 20 bp, Artificial sequence
  Single strand DNA oligonucleotide
tagtcgatgacgtgctggag

SEQ ID NO: 98 - DNA, 20 bp, Artificial sequence
  Single strand DNA oligonucleotide
ctacagcgcgtcatcgacta

SEQ ID NO: 99 - DNA, 21 bp, Artificial sequence
  Single strand DNA oligonucleotide
tcgttggagatgacaagttcc

SEQ ID NO: 100 - DNA, 20 bp, Artificial sequence
  Single strand DNA oligonucleotide
gcgctccgagaatttaaaga

SEQ ID NO: 101 - DNA, 19 bp, Artificial sequence
  Single strand DNA oligonucleotide
gtcgctgctgttagcgaag

SEQ ID NO: 102 - DNA, 20 bp, Artificial sequence
  Single strand DNA oligonucleotide
gatttgtgggcctgaagaaa

SEQ ID NO: 103 - DNA, 20 bp, Artificial sequence
  Single strand DNA oligonucleotide
cagatccatggaggaaggaa

SEQ ID NO: 104 - DNA, 19 bp, Artificial sequence
  Single strand DNA oligonucleotide
agctgctggagctcgtctt

SEQ ID NO: 105 - DNA, 20 bp, Artificial sequence
  Single strand DNA oligonucleotide
cgcctgttctggaaccatac

SEQ ID NO: 106 - DNA, 24 bp, Artificial Sequence
  Single strand DNA oligonucleotide
taaattttaaattaattaaattat

SEQ ID NO: 107 - DNA, 29 bp, Artificial Sequence
  Single strand DNA oligonucleotide
tgttttagaaagaattttaagtgtagaga

SEQ ID NO: 108 - DNA, 2457 bp, Homo sapiens
  misc_feature (1)..(37): 1st exon
  misc_feature (531)..(536): Premature polyA signal
  misc_feature (1033)..(1038): Premature polyA signal
  misc_feature (1051)..(1056): Premature polyA signal
  misc_feature (1569)..(1574): Premature polyA signal
  misc_feature (1669)..(2457): 2nd exon
  misc_feature (1712)..(1714): Putative translation start site
accgtcggggacccccaagctccgtcctccgcttcctgctctctttatcccgcccccgctccttctgggccaacgccgccagtgactattcccagggatccctcagagctgaggacgccgcggccgcatccccatttgggaccttgccccgactccgacctccggatctccagctccaccaaacctcgaagccaccatccgcccccaaactgccgctgcgccaggctttcggaggggagtcgtggcaacagccattaggatgcactaagcagggcacttcctgagcccaaggacaccgaggggcattcactgagtgaatggggatgtgctgctaataactaacactaattgaccacctgccgtgtgcccatcctcttcgaacatgcaacttccttgttccttatcttgttactgtctctttctctctgccagaatccaatcctcacaagggcagggactggggtctgttttgttaactgccatatcacaatgcctggcacgaaggaagattcttgaattaatgaatggagattaaattataatttaaaagcctggcatgaactgagcaccttctgcatgcttatcacccgctactgacatatagttcactttttttttttttttttttttgagacggagttttgctcttatctcccaggctggagtgcaagtggtgtgatctcagctcactgcaacctccgcctcccgggttcaagcgattcttctgcctcagcctcccgagtagctgggattacaggcgtccaccaccactcctggctaatttttttgtgtttttattagagacagggtttcgcaatgttgggcaggctggtctcgaactcctgacctcaggtgatccacccgactcggcctccaaagtgctgggattacaggcgtgagccattgtgccccgccccctttttaacctagtttgttgtctctcaccccgaccagaatataaccttcatgagggctacagtttgttgtctatttattgcccaactccatgtccttgccacacagtaggttcccaataaatgtatgttgaataattaataaagactacattctaatgataatggctaacagaccacgtgatttacatatttatttggtttattatattatctgcctctgccttttagaacataaaccttctgggggtgggaatgttgggtccctactgtctggcaggcactgtgctgggctagggttcaatggtgaccaaaaccggcaaaatcctgccctccctctgtcatggggaggaactgctaatgggcatggggattcttttctgggtgaggaaaatgttctaaaatttacttatggtgatagttgcacaacttcgtgaatatgctaaaacccgttaaattggacactagctggctgaacttgatgggatgtaaattacatctcaataaagctgtttgggaaatccagccttcacagttgttgattcgcgtgaggagggaaggagagatggggggacgtgggacagggagaaaacaacataaatcatatatatatagcatgcaaattggaaggtgatcagcacacaataggcattcaataaatgttgaaataatgacaccccactgtctccttgccctcaaatggtctcccctaacgtatcccctgttgtcttgcttcttctcttcccacttgcagagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtga

SEQ ID NO: 109 - DNA, 826 bp, Homo sapiens
  misc_feature (81)..(83): Putative translation start site
accgtcggggacccccaagctccgtcctccgcttcctagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtga

SEQ ID NO: 110 - DNA, 7979 bp, Artificial Sequence
  reverse tetracycline transactivator (M2rtTA) - vector
cgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattaacccgtgtcggctccagatctggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacgaagcttgggcccgggaattaattcaccatgtctagactggacaagagcaaagtcataaacggcgctctggaattactcaatggagtcggtatcgaaggcctgacgacaaggaaactcgctcaaaagctgggagttgagcagcctaccctgtactggcacgtgaagaacaagcgggccctgctcgatgccctgccaatcgagatgctggacaggcatcatacccacttctgccccctggaaggcgagtcatggcaagactttctgcggaacaacgccaagtcattccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggaacaggagcatcaagtagcaaaagaggaaagagagacacctaccaccgattctatgcccccacttctgagacaagcaattgagctgttcgaccggcagggagccgaacctgccttccttttcggcctggaactaatcatatgtggcctggagaaacagctaaagtgcgaaagcggcgggccggccgacgcccttgacgattttgacttagacatgctcccagccgatgcccttgacgactttgaccttgatatgctgcctgctgacgctcttgacgattttgaccttgacatgctccccgggtaactaagtaaggatcaattcgatatcaagcttat

SEQ ID NO: 111 - DNA, 1201 bp, Homo sapiens
aatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaaaaaaaaaaaaaaaaaa

SEQ ID NO: 112 - DNA, 1902 bp, Homo sapiens; identical to SEQ ID NO: 71

SEQ ID NO: 113 - DNA, 123 bp, Homo sapiens
  misc_feature (1)..(123): P66 alpha coiled-coil domain coding sequence
cctgaagaacgagaaaggatgatcaagcagctgaaggaagaattgaggttagaagaagcaaaactcgtgttgttgaaaaagttgcggcagagtcaaatacaaaaggaagccaccgcccagaag

SEQ ID NO: 114 - protein, 41 aa, Homo sapiens
  MISC_FEATURE (1)..(41): P66 alpha coiled-coil domain
PEERERMIKQLKEELRLEEAKLVLLKKLRQSQIQKEATAQK

SEQ ID NO: 115 - DNA, 30 bp, Artificial Sequence
  Single strand DNA oligonucleotide
aaaaaaaccggtcctgaagaacgagaaagg

SEQ ID NO: 116 - DNA, 27 bp, Artificial Sequence
  Single strand DNA oligonucleotide
aaaaaacttaagcttctgggcggtggc

SEQ ID NO: 117 - protein, 426 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 118 - protein, 232 aa, Homo sapiens
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 119 - protein, 88 aa, Homo sapiens
MKVLAAVHSPGGAVPQQPGQAMWPQRDGLPALPRQRHGEGQAGGAVPHSRVPWHLPGQHHPGPEDPQPQCPQPPQQAQRHRRHPARPP

SEQ ID NO: 120 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 121 - protein, 433 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 122 - protein, 420 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 123 - DNA, 2175 bp, Homo sapiens
agtacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgcccttgctttggctgagaggatttctgttggcaagttgctggattatagtgaggagttcccccaccccaggatccgaggggcacagcgcggcccccgactgtccgtcctgtgcgctggccgccctcccaaaggatgtacccaactctcagccagagatggtggaggccgtcaagaagcacattttaaacatgctgcacttgaagaagagacccgatgtcacccagccggtacccaaggcggcgcttctgaacgcgatcagaaagcttcatgtgggcaaagtcggggagaacgggtatgtggagatagaggatgacattggaaggagggcagaaatgaatgaacttatggagcagacctcggagatcatcacgtttgccgagtcaggaacagccaggaagacgctgcacttcgagatttccaaggaaggcagtgacctgtcagtggtggagcgtgcagaagtctggctcttcctaaaagtccccaaggccaacaggaccaggaccaaagtcaccatccgcctcttccagcagcagaagcacccgcagggcagcttggacacaggggaagaggccgaggaagtgggcttaaagggggagaggagtgaactgttgctctctgaaaaagtagtagacgctcggaagagcacctggcatgtcttccctgtctccagcagcatccagcggttgctggaccagggcaagagctccctggacgttcggattgcctgtgagcagtgccaggagagtggcgccagcttggttctcctgggcaagaagaagaagaaagaagaggagggggaagggaaaaagaagggcggaggtgaaggtggggcaggagcagatgaggaaaaggagcagtcgcacagacctttcctcatgctgcaggcccggcagtctgaagaccaccctcatcgccggcgtcggcggggcttggagtgtgatggcaaggtcaacatctgctgtaagaaacagttctttgtcagtttcaaggacatcggctggaatgactggatcattgctccctctggctatcatgccaactactgcgagggtgagtgcccgagccatatagcaggcacgtccgggtcctcactgtccttccactcaacagtcatcaaccactaccgcatgcggggccatagcccctttgccaacctcaaatcgtgctgtgtgcccaccaagctgagacccatgtccatgttgtactatgatgatggtcaaaacatcatcaaaaaggacattcagaacatgatcgtggaggagtgtgggtgctcatagagttgcccagcccagggggaaagggagcaagagttgtccagagaagacagtggcaaaatgaagaaatttttaaggtttctgagttaaccagaaaaatagaaattaaaaacaaaacaaaaaaaaaaacaaaaaaaaacaaaagtaaattaaaaacaaaacctgatgaaacagatgaaggaagatgtggaaaaaatccttagccagggctcagagatgaagcagtgaaagagacaggaattgggagggaaagggagaatggtgtaccctttatttcttctgaaatcacactgatgacatcagttgtttaaacggggtattgtcctttccccccttgaggttcccttgtgagccttgaatcaaccaatctagtctgcagtagtgtggactagaacaacccaaatagcatctagaaagccatgagtttgaaagggcccatcacaggcactttcctacccaattacccaggtcataaggtatgtctgtgtgacacttatctctgtgtatatcagcatacacacacacacacacacacacacacacacacacaggcatttccacacattacatatatacacatactggtaaaagaacaatcgtgtgcaggtggtcacacttcctttttctgtaccacttttgcaacaaaacaa

SEQ ID NO: 124 - DNA, 3029 bp, Homo sapiens
ccgcagagaggtgtggtcagggacatttcccctggccgggagcccatggagcactgtcctcagagatgcgcaggttaggctcactgtctaggccaggcccaccttagtcactgtggactggcaatggaagctcttcctggacacacctgccctagccctcaccctggggtggaagagaaatgagcttggcttgcaactcagaccattccacggaggcatcctccccttcctgggctggtgaataaaagtttcctgaggtcaaggacttccttttccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaaggaaaaaaaaaaaaaaaaa

SEQ ID NO: 125 - protein, 508 aa, Homo sapiens
MSSDDRHLGSSCGSFIKTEPSSPSSGIDALSHHSPSGSSDASGGFGLALGTHANGLDSPPMFAGAGLGGTPCRKSYEDCASGIMEDSAIKCEYMLNAIPKRLCLVCGDIASGYHYGVASCEACKAFFKRTIQGNIEYSCPATNECEITKRRRKSCQACRFMKCLKVGMLKEGVRLDRVRGGRQKYKRRLDSESSPYLSLQISPPAKKPLTKIVSYLLVAEPDKLYAMPPPGMPEGDIKALTTLCDLADRELVVIIGWAKHIPGFSSLSLGDQMSLLQSAWMEILILGIVYRSLPYDDKLVYAEDYIMDEEHSRLAGLLELYRAILQLVRRYKKLKVEKEEFVTLKALALANSDSMYIEDLEAVQKLQDLLHEALQDYELSQRHEEPWRTGKLLLTLPLLRQTAAKAVQHFYSVKLQGKVPMHKLFLEMLEAKVGQEQLRGSPKDERMSSHDGKCPFQSAAFTSRDQSNSPGIPNPRPSSPTPLNERGRQISPSTRTPGGQGKHLWLTM

SEQ ID NO: 126 - protein, 355 aa, Homo sapiens
MALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEAKPKRGRRSWPRKRTATHTCSYAGCGKTYTKSSHLKAHLRTHTGEKPYHCNWDGCGWKFARSDELTRHYRKHTGHRPFQCHLCDRAFSRSDHLALHMKRHM

SEQ ID NO: 127 - DNA, 1655 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggcgccgaggccgccccggagccgccgccgccgcccccgccgcctgcgttctattaccccgaacccggcgcgcccccgccctacagcgcccccgcgggtggcctggtgtctgagctgctgcgacccgagctggatgcgccgctggggcccgcactgcacggccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggccgccccccgccgccgcccgacacaccgccgctcagccccgacggccccgcgcgcctgcccgcgcccggtccgcgcgcctccttcccgccgcctttcggtggccctggtttcggcgcgcccgggcccggcctgcattacgcgccgcctgcgcccccagccttcggtctcttcgacgacgcggccgccgccgcggcagccctgggcctggcgccccccgccgcccgcggtctcctcacgccgcctgcgtccccgctggagctgctggaggccaagccaaagcgcggccgccgctcttggccccgcaaacgcaccgccactcacacctgcagctacgcgggctgcggcaagacctacaccaagagttcgcatctgaaggcgcatctgcgcacgcacacaggtgagaagccctaccactgcaactgggacggctgcggctggaagtttgcgcgctcagacgagctcacgcgccactaccgaaagcacacgggccaccggccattccagtgccatctgtgcgatcgtgccttctcgcgctccgatcacctggcgctgcacatgaaacggcacatgtagccgggacgcccccgcccacctgcgcgcggccgtggcgggtcccacgcgccgggcgcggccccctcccaaactgtgactggtatttattggacccagagaaccgggccgggcacagcgtggctacagagggtctccctcgatgacgacgacgacgacgccaccaccccagcccccgtctgtgactgaaggcccggtgggaaaagaccacgatcctccttgacgagttttgtttttcaaaatggtgcaataatttaagtggcatcttctctcccaccgggtctacactagaggatcgaggcttgtgatgccttgtgagaaataagggccttaatttgtactgtctgcggcattttttataatattgtatatagtgactgacaaatattgtattactgtacatagagagacaggtgggcatttttgggctacctggttcgtttttataagattttgctgggttggttttttttttaattaaaaagttttgcatcttttaaaaaaaa

SEQ ID NO: 128 - protein, 723 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 129 - protein, 743 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 130 - DNA, 4754 bp, Homo sapiens
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctaaaaaaaaaaaaaaaaaaaaaaaaaaaaaaa

SEQ ID NO: 131 - DNA, 4814 bp, Homo sapiens
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctaaaaaaaaaaaaaaaaaaaaaaaaaaaaaaa

SEQ ID NO: 132 - protein, 233 aa, Homo sapiens
MELPTKPGTFDLGLATWSPSFQGETHRAQARRRDVGRQLPEYKAVVVGASGVGKSALTIQLNHQCFVEDHDPTIQDSYWKELTLDSGDCILNVLDTAGQAIHRALRDQCLAVCDGVLGVFALDDPSSLIQLQQIWATWGPHPAQPLVLVGNKCDLVTTAGDAHAAAAALAHSWGAHFVETSAKTRQGVEEAFSLLVHEIQRVQEAMAKEPMARSCREKTRHQKATCHCGCSVA

SEQ ID NO: 133 - DNA, 826 bp, Homo sapiens
agagcgtcccagcgcgcccgcctccccacggacacagagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtga

SEQ ID NO: 134 - protein, 536 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 135 - DNA, 4131 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagttaaaaaaaaaaaaaaaaaa

SEQ ID NO: 136 - DNA, 4056 bp, Homo sapiens
ggcccggaatccattccggcctgggagccggagcggccaggccgccgtctgcccgtcccgctggacgtcccgcggtccgccctcccgtgcgtccgtctgccggtgagcccgcccgcccgccggcccagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagttaaaaaaaaaaaaaaaaaa

SEQ ID NO: 137 - protein, 358 aa, Homo sapiens
MGLSRKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 138 - protein, 339 aa, Homo sapiens
MGLLKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 139 - protein, 355 aa, Homo sapiens
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 140 - protein, 357 aa, Homo sapiens
MSARKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 141 - protein, 321 aa, Homo sapiens
MSARKSSDASACSSSEISVKEFLAKAKEDFLKKWENPTQNNAGLEDFERKKTLGTGSFGRVMLVKHKATEQYYAMKILDKQKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 142 - protein, 338 aa, Homo sapiens
MLLLSSSISLYKDRNEARLISSQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 143 - protein, 351 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 144 - protein, 398 aa, Homo sapiens
MAAYREPPCNQYTGTTTALQKLEGFASRLFHRHSKGTAHDQKTALENDSLHFSEHTALWDRSMKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 145 - protein, 257 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 146 - protein, 351 aa, Homo sapiens
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 147 - protein, 343 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 148 - protein, 408 aa, Homo sapiens
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 149 - protein, 1537 aa, Homo sapiens
MGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAATPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 150 - protein, 634 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQAGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 151 - DNA, 5386 bp, Homo sapiens
ttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaagcaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactggaaaaaaaaaaaaaaaaaa

SEQ ID NO: 152 - protein, 633 aa, Homo sapiens
MTEEACRTRSQKRALERDPTEDDVESKKIKMERGLLASDLNTDGDMRVTPEPGAGPTQGLLRATEATAMAMGRGEGLVGDGPVDMRTSHSDMKSERRPPSPDVIVLSDNEQPSSPRVNGLTTVALKETSTEALMKSSPEERERMIKQLKEELRLEEAKLVLLKKLRQSQIQKEATAQKPTGSVGSTVTTPPPLVRGTQNIPAGKPSLQTSSARMPGSVIPPPLVRGGQQASSKLGPQASSQVVMPPLVRGAQQIHSIRQHSSTGPPPLLLAPRASVPSVQIQGQRIIQQGLIRVANVPNTSLLVNIPQPTPASLKGTTATSAQANSTPTSVASVVTSAESPASRQAAAKLALRKQLEKTLLEIPPPKPPAPEMNFLPSAANNEFIYLVGLEEVVQNLLETQGRMSAATVLSREPYMCAQCKTDFTCRWREEKSGAIMCENCMTTNQKKALKVEHTSRLKAAFVKALQQEQEIEQRLLQQGTAPAQAKAEPTAAPHPVLKQVIKPRRKLAFRSGEARDWSNGAVLQASSQLSRGSATTPRGVLHTFSPSPKLQNSASATALVSRTGRHSERTVSAGKGSATSNWKKTPLSTGGTLAFVSPSLAVHKSSSAVDRQREYLLDMIPPRSIPQSATWK

SEQ ID NO: 153 - DNA, 5689 bp, Homo sapiens
gggcaatttcagtgtgagactgagccgcgagactgagctgcggctccgagcgctgcgcggcggctcctcccgcccagggtcagcgccccggcgcgcgcacgcgcacccccgccgcccgagcgcgccccgcgccgcccgcgcagtcggtcggtcggtcgtctgtcctgtcgccgctgccgccgccgccacagcggccgccgcgggcgccacctgagggagtcgcctccgcgggacgccacaagacctgaccggactgcgccgcccgaggccgtcggccgccgtcagcgagggcgccgagcaacttcgttcagaatgaccgaagaagcatgccgaacacggagtcagaaacgagcgcttgaacgggacccaacagaggacgatgtggagagcaagaaaataaaaatggagagaggattgttggcttcagatttaaacactgacggagacatgagggtgacacctgagccgggagcaggtccaacccaaggattgctgagggcaacagaggccacggccatggccatgggcagaggcgaagggctggtgggcgatgggcccgtggacatgcgcacctcacacagtgacatgaagtccgagaggagacccccctcacctgacgtgattgtgctctccgacaacgagcagccctcgagcccgagagtgaatgggctgaccacggtggccttgaaggagactagcaccgaggccctcatgaaaagcagtcctgaagaacgagaaaggatgatcaagcagctgaaggaagaattgaggttagaagaagcaaaactcgtgttgttgaaaaagttgcggcagagtcaaatacaaaaggaagccaccgcccagaagcccacaggttctgttgggagcaccgtgaccacccctcccccgcttgttcggggcactcagaacattcctgctggcaagccatcactccagacctcttcagctcggatgcccggcagtgtcatacccccgcccctggtccgaggtgggcagcaggcgtcctcgaagctggggccacaggcgagctcacaggtcgtcatgcccccactcgtcaggggggctcagcaaatccacagcattaggcaacattccagcacagggccaccgcccctcctcctggccccccgggcgtcggtgcccagtgtgcagattcagggacagaggatcatccagcagggcctcatccgcgtcgccaatgttcccaacaccagcctgctcgtcaacatcccacagcccaccccagcatcactgaaggggacaacagccacctccgctcaggccaactccacccccactagtgtggcctctgtggtcacctctgccgagtctccagcaagccgacaggcggccgccaagctggcgctgcgcaaacagctggagaagacgctactcgagatccccccacccaagcccccagccccagagatgaacttcctgcccagcgccgccaacaacgagttcatctacctggtcggcctggaggaggtggtgcagaacctactggagacacaaggcaggatgtcggccgccactgtgctgtcccgggagccctacatgtgtgcacagtgcaagacggacttcacgtgccgctggcgggaggagaagagcggcgccatcatgtgtgagaactgcatgacaaccaaccagaagaaggcgctcaaggtggagcacaccagccggctgaaggccgcctttgtgaaggcgctgcagcaggaacaggagattgagcagcggctcctgcagcagggcacggcccctgcacaggccaaggccgagcccaccgctgccccacaccccgtgctgaagcaggtcataaaaccccggcgtaagttggcgttccgctcaggagaggcccgcgactggagtaacggggctgtgctacaggcctccagccagctgtcccggggttcggccacgacgccccgaggtgtcctgcacacgttcagtccgtcacccaaactgcagaactcagcctcggccacagccctggtcagcaggaccggcagacattctgagagaaccgtgagcgccggcaagggcagcgccacctccaactggaagaagacgcccctcagcacaggcgggacccttgcgtttgtcagcccaagcctggcggtgcacaagagctcctcggccgtggaccgccagcgagagtacctcctggacatgatcccaccccgctccatcccccagtcagccacgtggaaatagtgcgagccaggccccgtggaagacgggctccctcctcccccacctggcccctggtctagaaggacccactgcaccaccctccgctggctcgggaagacaccgtgcccgccccaagagcaagcaccggccatgctgcagaggcaagacctcaattcttggctgcaaagtttcatcagggctagggggctggtgccgcctcataggcagacgaggatcatcgctgggggacctttcccgtgggctttcttcctttctctctttgcctttagtttgcccgacaccagcagaaaagtggaccttgggggctggttctgctcctggcccccttgttcagcccctgccggcacacgggcggctcaccctggacactgtgatgcgcatgggcaaggccagcgcccggggcttctgaaccgagcggggtgtttcatttttttgcttttccctgtcttaggctcccagtctttgactgccttcccatggcgatctataagttgaaagattttttttttttttaatcacctcatgatgatggagttaaaagtaaaccgtgcagaccctggggtccctgttgtacgctgcatcatcccgctggccctgtgccctggagggtgggcggctcatggtgccacagcccctggcagggacggccggcccgcccccgtgactgactgacagatgcagggatggccgaggcagccctcgctccagctgaacgcctccattgctgcttgttctggagacccccgcccccgcaccttccagacttagcagaagaacaaactgaagaacagacccagccagagaagcagggattccagaagctgcccattaagggagaaggagaggatccggtcggcagcagccctgagcagaaagctggaggggggactgtcgcggggtttttctgttgtggtttattttattaaattttttccttttttctattcatttcgatggacgcaatcttaagccaccctggccttgctcctgggaggtgagcgtgcacaggtgtgtgcaggtcaggaggtgccgtccaggtgtgcggcgagccgctgcgcacagatgtcaggatttccgtttgggtctagtttagaacctgtccttaaacctaggggttgctgtcaggatttgctttcagactttttttttttttgtaattccctttagagtctacaaaaatgtttttaaaaggatcaggtctgcttttagtttcatttttgtttctttcccgtcccactctttaaaaactggttccgtgaggaaaggcagaagccgttccgtgtctcttgcaggctgggccggcttcatgccagtgcgagggcgtcccgtgcccacgtacatacgtatgtctccatgagttctgggctccactggttccaattgagctccagccctggttttcctacccatgcagttagggactttaatttaattttttttttgtagggccaccgccttcaaacacaactgctacaacattctaataaaggctcatttaacccccaggctcctgtcgtgtgaatatcctcagtctgtaggaaactttttttgacacagcatagaagacctagttttggaaaacattatctaattttttgttgtgcaaatccccaaatttctcactaatttttgtttttttgtgcataacttggatgggctgaaggaggtgaggacagattggggaagggtggctttcattccaagatccagggatttggggaaaaggaaggaatttgatgttttttggggtgggaggggagggtgtgttttttacaccaaaaaaaaaaaaaaaaatcaagagtatgcaagcatttctattcctcgcatttttctgtgtgcctggcaaataaatacctgtctcctacgaccctgagctgttagccctctctgttccatgacaggggccagatcttccagctcctcccagaaggagcacccaggctggcttcttcccactgaaagccctccccagcgaaccaacctcagttctatgcagtggctggggatcaggcatccagaccgaagtcacctctgcctgctccagcttgggtcagctgggtctgaccagggggccagatccgagccgcacctgccggcccccagccccagctccagctcctgacctctcccagcctggcctggctgttcctccagggctgatggctgtcaacccatccttgtgagttcatatggactgctgcccctcgaaagggagagggtcggccccatgtccccagggagcattccatcagggacaacgtacatactgtgatgtaaactttttttttttccccccagggggcaaaagtgtgagatgccttaatctttccttcatttctgctgtctcgaacactctagcccattatttcctttcagttccttgcagcataacctctacgataagccccaagcgggttgttgtattatgacgtttatgatgttccaggtgaaggcattattaagtacctctctgggtgtggggtttggacgcaccaggatagctattgattaatgttaagggtgttctacccacagcaaagcacaccctcttaaaccaggcactgcctgggtcctggtcccgagagccctaccaggatcaggttcctgcaagccgtcagaatgtgggagcccccagcccaactgattgtaactgtcccctgttacctgtgacatgaacctccaacagcacctggaaacggttccctctgtcagctgctctgtagacagggctggggagatctcagagttcacacctcgcctgttgtaggggaggttgggggtagggtttggaatggccaagtgcccttggaacctcccacagctatggccgtcctgacctcatcccaggaactctacggtgaccaggaaccacccctctgacgaggtctgtagcggcccttctcagagtggaacagcccacagtgctagttgtgcctggtcttacctgtactccacggacctcggtgaagcaaaagcttcagggcagagggaatgaggcaacccagtggcagccccgctgggccccgtggctcctgctctcctattggacgtagaggcaggggagagacttctctatacaaatattctcatcacagaagggatgatccttgctgctctgccgtagggtttttgatgctgagctatgctgcacatgacgttaacctaaagaacttggactgagcttttaaaaaaggacagcaaacaattttataatccttaaagtgtaatagacggttacactagtgcagggtattggggaggctctttgggtgtggaggctgtcacttgtatttattgtgactctaaatctttgatagtaaaacaaatgtaaaaagaaatgtttgccaccagatgggaatagaagttccaataagcaggctggaatgggtggctatacgttgtatcacgaggaagttttagactctgaaggataataaatggatgatgtgtcaactggaaaaaaaaaaaaaaaaaa

SEQ ID NO: 154 - protein, 389 aa, Homo sapiens
MYGRPQAEMEQEAGELSRWQAAHQAAQDNENSAPILNMSSSSGSSGVHTSWNQGLPSIQHFPHSAEMLGSPLVSVEAPGQNVNEGGPQFSMPLPERGMSYCPQATLTPSRMIYCQRMSPPQQEMTIFSGPQLMPVGEPNIPRVARPFGGNLRMPPNGLPVSASTGIPIMSHTGNPPVPYPGLSTVPSDETLLGPTVPSTEAQAVLPSMAQMLPPQDAHDLGMPPAESQSLLVLGSQDSLVSQPDSQEGPFLPEQPGPAPQTVEKNSRPQEGTGRRGSSEARPYCCNYENCGKAYTKRSHLVSHQRKHTGERPYSCNWESCSWSFFRSDELRRHMRVHTRYRPYKCDQCSREFMRSDHLKQHQKTHRPGPSDPQANNNNGEQDSPPAAGP

SEQ ID NO: 155 - DNA, 3131 bp, Homo sapiens
gccgtggtggctggttccctgtctcttcagtagagagtctagaccccacccagtcttcatgtacggccgaccgcaggctgagatggaacaggaggctggggagctgagccggtggcaggcggcgcaccaggctgcccaggataacgagaactcagcgcccatcttgaacatgtcttcatcttctggaagctctggagtgcacacctcttggaaccaaggcctaccaagcattcagcactttcctcacagcgcagagatgctggggtcccctttggtgtctgttgaggcgccggggcagaatgtgaatgaaggggggccacagttcagtatgccactgcctgagcgtggtatgagctactgcccccaagcgactctcactccttcccggatgatttactgtcagagaatgtctccccctcagcaagagatgacgattttcagtgggccccaactaatgcccgtaggagagcccaatattccaagggtagccaggcccttcggtgggaatctaaggatgccccccaatgggctgccagtctcggcttccactggaatcccaataatgtcccacactgggaaccctccagtgccttaccctggcctctcgacagtaccttctgacgaaacattgttgggcccgactgtgccttccactgaggcccaggcagtgctcccctccatggctcagatgttgcccccgcaagatgcccatgaccttgggatgcccccagctgagtcccagtcattgctggttttaggatctcaggactctcttgtcagtcagccagactctcaagaaggcccatttctaccagagcagcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaacaatggagagcaggacagtcctcctgctgctggtccttaggtgaatgaagaaggaagaggattccaggctgagagcactggacgtggcaactgttcagaggagaggcagtcttcaagttctacattcattcagaaaaatgttttttgagcctacaatactgagcgcaacaaggctgtggagacccatggtgaggagcatggagttaactaaaggatgtgtcagggaagaaagacttctcaaggaggtgcctccatcagacccaaaggactcatgggggctagctgcacctcacatttcttggacatataccgttggacatgtctatcttctggaaactatggcatggacagtaaggattcagaagtgcatgaaggcaccctgcctctgcagagcagaaagatcatagacaacatttatgaatgtgcccagtgctgccaagaagagaagccggtcctctgcaggctcaagcctatctgggcctctggggaagccccacagccttggctgtgcctgcccctgccctctcacccctaccctgaccttgtcctacttcactgcctttgtctgtgttactagtggccccagtatacctgggatggacatccaggtgcccttcatccaagctcctatgtgaggggaatggacattattaaaagaacaggggcagaagtggctcatttatgacccattcactagccccagggattgaagtcttgggtactcaaagtgtctttctaccagggcaccagatcccttccatggagcaggtcatctcgggttcactgggccagggatggtctctgttccccagcccacctggctcacacacagcctcatgggtagggtcagcaaaccagatggcttgttgttggaatgtaggatgagaggcctgcttggtgacctagcattttcaccaagaagtggacgtggagaggaccagagtgatcaagggtgtatgatgtgcactacaatggtgggcaaaacaggctcctgctcttgtggaggtcacaatctagcggagaaaggatgttactagaagtacacaaattgggcccggcgcgatggctcacgcctgtaatcccagcacttttggaggccgaggcaggcggatcatttgaggttagagattcgagaccagccgggccaacatggtgaaaccccatctctacaaaaaatacaaaaattagcctggcatatggcgggtaccgtaatcctagctactcgggagactgacgggagaatcgcttgaacccaggaggcggaggttgcagtgagctcagatctcaccattgcactccagcctgggcgactgagcgagactctatctcaaaacaatcaaaacaaaaaagacctgtggactctagtagattttgaatcctgcctctgccatttcctggctatgaggtgtcttgagaaatttacttgtcactcttgcttctgatagtaaaggggatggtgcgatagattcaagatggagagataaggttaagtgttttctttggctgcaacatggagattagattagagcaaggatgtaagggagaggaagggacatagcagtatttcaggtgagagtcaaggtggctttggctagggtgtgagagtggaggtagggagaagtaggaaagtgatagttaactggatttgttaggtgagggtgaggccaagggtgacttccaggttcctgacttgtgttataagtaacacagaagaagaatggatgaacttgattcgttttccattgattgtgatatctatcatacctgcaaaaaatattttgtatatatccaatttaataataaatgcactcatgttaggaaggtcaaaaaaaaggaaaaaagaaaaataataaaaaataataaaaatccttaggataacttgaggccaggagtttgagaccagtgtgaccttgtctctgtaaaaaataaaattaaaagaaaaa

SEQ ID NO: 156 - protein, 273 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 157 - DNA, 5460 bp, Homo sapiens
gggcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatcccactatacaaatgcaaatggttgcctggttccatttatgcaagggagccagtactgaattatgccttggcagaggggagactccaaaagagtcatcgcaggaagaagttaagaacactgaacatcagaacagtctgccaagaaggacattggcatcctgggaaagtccgccttttcccttgaccactatagggtgtataaatcgtgtttgcaaaatgtgttatgatgtgtttatattctaaaactattacagagctatgtaaagggacttaggagaaaatgctgaatgtaagatggtcccatttcaatttccaccatgggagagcctaaaaataaattatgacatttagtatctaaggttagaaaaccacgcccacatgctaatatgggtgttgaaaactaggttacttataatgcaaggaatcaggaaactttagttatttatagtataatcaccattatctgtttaaaggatccatttagttaaaatcgggcactctatattcattaaggtttatgaattaaaaagaaagctttatgtagttatgcatgtcagtttgctatttaaaatgtgtgacagtgtttgtcatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtgataacattattgccatgttctacaaccgtaagatgacagttttcaatgtagtgacacaaaagggcatgaaaaactaactgctagctttcctttcatttcaaaagtccaagaatttctagtatatttggattttagcttctgttcaaagcaaatccagatgcaactccagtaagtggcctttgctcttttttgtaccaaagagcccagatgattcctacagtccctttcttctctaacatgctgtggttccttaaatatgagtaatttctctaagatataacccaggtgctttgagaagctgcattaaggtgttcaggccctcagatatcacatggtacacttgattagtaataaaaccagagatcaatttaaattgctgataggtcctgtctcagtgtgtggcattgactgttttcaggaaaatagatacagattaatatgagttatgcgtgtaggttgtgtatagattgagaagatagatacttctcaatctagtagtttgatttatttaaccaatggtttcagtttgcttgagcatatgaaaatcctgcttaatgtgcttaagagtataataaatgtgtacttttgtcctcaaacctagtagctgggttttaacactcatggacatggtcttaatcaatggagttaaataaacaaattcagcaagttattaaatctgacatggtaggagaggggagatgtgtcctgcttattaaatgtgttggtccattgaaagttacatggattgccaatttttaaaacactaaagttgaataaaatgcatgaacaatagaaaaatgctgaacattattttggatgctagctgcttggacattaactgtgttatttctgctttgagatgaaaatatatatttatctttgcttattttatcccagatgtgttctgaatatccttcttcataaatcatggaaaactcactgctgagatagtaaaccatgaaatcgccttttcagttggtgccatgtatctgacagttccatcttggaaggtttcaaaattaccttttaaaatgatctcagaagtctgtagattctcaatgatactgaaagctttgcacctctttggtagaaaccaggtctatttagaaaatggctttatgataaatgttgcctcctgagtgataatgaagtgttcctggatattgtattgtaatttaatgtgcttaccacactgccacattttaatgagtcagagaaaaattaatttttcttcaatacaataatagaacaagtagcctattctcttaaaaagtatgtgaaaagaaaattatgaaaaaatatgcatacctaatgaagtattggttttagtaagaattaaatacatttcattgagctttaaagtactttggagaaactttggggcacgttttcctactctaattcaactaaagttataaataaagagaaaaactcattcagaaatcatggattttaaaaatattttactgcagccaagttttcatttcaaaatgtaatttcagtttggagcttttaggcattatgtatatttaaaaaatatattcttcaaaaatgcattttggcatggtgggatggatgttgcaaaagatatccggagcctccagtctgtcattaactgatatggtaaatcacctctcttctttgggtctcaattttttatttatctatatggtaaactcagagatcactccttaggggtgagtcctattgcaatatgaccgacaaagaagacaaaatagcattgaaactaacccatacaaaatatccaactctggattctgtgaataagtatcttgaccataaaaagtcattgctgttcttgtttctaatgtaaatagtgtccattagtaaaagtgaaattcagtcttaagtagggtgaattggatcaccatttacacaagagatggctttttcctttgcttgaataaacattttggatcacctccaaagaatgaaaaccagtagtacgttttagtcatattagtcaggatgagaaactataagatgtgtgtaacatttggaaatgcaccaaagtgagcgtttaaatcttctcattttattgaaaactaagagcagaaaatgtaaaatgctcatgaaggttttgaatgccaaaagatattttagaatcaatttataaaggggtaattcattaattacactttaaaattggaaagtgggataagaaatctaaagtaaaccagcttatctttgaaacaatattattttgaaattggctttaaaataaaaccattcagattgaaattctaattagctcatttgtggagtttgatcacacaattcataatgttgctgctttccattaactagtcttgaaatgcctttgtttgtaaaaataaaataatggtactttcattttataacaaggtgtttttttcaagaaataatccatgctaaaatggatatttgtgatcctgaaatgtttactaagcattgtaaatttatttataactgccatctccaactacatccttatgatgtttttaacaataaaattaaaacaactgttaaactaaaaaccacaccgttttccagtacttgatctctgagctacaatactcactaaatataattttccaatcaaaatattctattctatattctaagggttaatatgtgattatagtgtccacttgccaccatttttttaaatcaatggacttgaaaagtattaatttagatggatgcgcagatataccctcagttcagtcatagattggagtttgcatataataatgtaaatgtatgtcgacactattctaaatagttctattatgactgaaatttaattaaataaaaaaggttgtaaaatgtgatgtgtatgtgtatatactgtatgtgtactttttaaaataggtgtatgtcccaacccttttttatacaggtttgaatttaaaattacatgatatatacatatactttattgttctaaataaagaattttatgcactctcaaaaaaaaaaaaaaaaaa

SEQ ID NO: 158 - protein, 245 aa, Homo sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKGKAKNPPGDSSLHWAAMALPALFSLIIGFAFGALYWKKRQPSLTRAVENIQINEEDNEISMLQEKEREFQEV

SEQ ID NO: 159 - DNA, 5376 bp, Homo sapiens
gggcttcgctcgccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtggatgaccttgtggagtgcgtgaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatcccactatacaaatgcaaatggttgcctggttccatttatgcaagggagccagtactgaattatgccttggcagaggggagactccaaaagagtcatcgcaggaagaagttaagaacactgaacatcagaacagtctgccaagaaggacattggcatcctgggaaagtccgccttttcccttgaccactatagggtgtataaatcgtgtttgcaaaatgtgttatgatgtgtttatattctaaaactattacagagctatgtaaagggacttaggagaaaatgctgaatgtaagatggtcccatttcaatttccaccatgggagagcctaaaaataaattatgacatttagtatctaaggttagaaaaccacgcccacatgctaatatgggtgttgaaaactaggttacttataatgcaaggaatcaggaaactttagttatttatagtataatcaccattatctgtttaaaggatccatttagttaaaatcgggcactctatattcattaaggtttatgaattaaaaagaaagctttatgtagttatgcatgtcagtttgctatttaaaatgtgtgacagtgtttgtcatattaagagtgaatttggcaggaattcccaagatggacattgtgcttttaaactagaacttgtaagacattatgtgaatatcccttgccaattttttttataataagaaaacatctgactaaagtcaaagaatgatttcttatggtttattttgatgaaagttcttttaacatgtcttgaatgtacacataaaggaatccaaagctttccattctaacttaatctttgtgataacattattgccatgttctacaaccgtaagatgacagttttcaatgtagtgacacaaaagggcatgaaaaactaactgctagctttcctttcatttcaaaagtccaagaatttctagtatatttggattttagcttctgttcaaagcaaatccagatgcaactccagtaagtggcctttgctcttttttgtaccaaagagcccagatgattcctacagtccctttcttctctaacatgctgtggttccttaaatatgagtaatttctctaagatataacccaggtgctttgagaagctgcattaaggtgttcaggccctcagatatcacatggtacacttgattagtaataaaaccagagatcaatttaaattgctgataggtcctgtctcagtgtgtggcattgactgttttcaggaaaatagatacagattaatatgagttatgcgtgtaggttgtgtatagattgagaagatagatacttctcaatctagtagtttgatttatttaaccaatggtttcagtttgcttgagcatatgaaaatcctgcttaatgtgcttaagagtataataaatgtgtacttttgtcctcaaacctagtagctgggttttaacactcatggacatggtcttaatcaatggagttaaataaacaaattcagcaagttattaaatctgacatggtaggagaggggagatgtgtcctgcttattaaatgtgttggtccattgaaagttacatggattgccaatttttaaaacactaaagttgaataaaatgcatgaacaatagaaaaatgctgaacattattttggatgctagctgcttggacattaactgtgttatttctgctttgagatgaaaatatatatttatctttgcttattttatcccagatgtgttctgaatatccttcttcataaatcatggaaaactcactgctgagatagtaaaccatgaaatcgccttttcagttggtgccatgtatctgacagttccatcttggaaggtttcaaaattaccttttaaaatgatctcagaagtctgtagattctcaatgatactgaaagctttgcacctctttggtagaaaccaggtctatttagaaaatggctttatgataaatgttgcctcctgagtgataatgaagtgttcctggatattgtattgtaatttaatgtgcttaccacactgccacattttaatgagtcagagaaaaattaatttttcttcaatacaataatagaacaagtagcctattctcttaaaaagtatgtgaaaagaaaattatgaaaaaatatgcatacctaatgaagtattggttttagtaagaattaaatacatttcattgagctttaaagtactttggagaaactttggggcacgttttcctactctaattcaactaaagttataaataaagagaaaaactcattcagaaatcatggattttaaaaatattttactgcagccaagttttcatttcaaaatgtaatttcagtttggagcttttaggcattatgtatatttaaaaaatatattcttcaaaaatgcattttggcatggtgggatggatgttgcaaaagatatccggagcctccagtctgtcattaactgatatggtaaatcacctctcttctttgggtctcaattttttatttatctatatggtaaactcagagatcactccttaggggtgagtcctattgcaatatgaccgacaaagaagacaaaatagcattgaaactaacccatacaaaatatccaactctggattctgtgaataagtatcttgaccataaaaagtcattgctgttcttgtttctaatgtaaatagtgtccattagtaaaagtgaaattcagtcttaagtagggtgaattggatcaccatttacacaagagatggctttttcctttgcttgaataaacattttggatcacctccaaagaatgaaaaccagtagtacgttttagtcatattagtcaggatgagaaactataagatgtgtgtaacatttggaaatgcaccaaagtgagcgtttaaatcttctcattttattgaaaactaagagcagaaaatgtaaaatgctcatgaaggttttgaatgccaaaagatattttagaatcaatttataaaggggtaattcattaattacactttaaaattggaaagtgggataagaaatctaaagtaaaccagcttatctttgaaacaatattattttgaaattggctttaaaataaaaccattcagattgaaattctaattagctcatttgtggagtttgatcacacaattcataatgttgctgctttccattaactagtcttgaaatgcctttgtttgtaaaaataaaataatggtactttcattttataacaaggtgtttttttcaagaaataatccatgctaaaatggatatttgtgatcctgaaatgtttactaagcattgtaaatttatttataactgccatctccaactacatccttatgatgtttttaacaataaaattaaaacaactgttaaactaaaaaccacaccgttttccagtacttgatctctgagctacaatactcactaaatataattttccaatcaaaatattctattctatattctaagggttaatatgtgattatagtgtccacttgccaccatttttttaaatcaatggacttgaaaagtattaatttagatggatgcgcagatataccctcagttcagtcatagattggagtttgcatataataatgtaaatgtatgtcgacactattctaaatagttctattatgactgaaatttaattaaataaaaaaggttgtaaaatgtgatgtgtatgtgtatatactgtatgtgtactttttaaaataggtgtatgtcccaacccttttttatacaggtttgaatttaaaattacatgatatatacatatactttattgttctaaataaagaattttatgcactctcaaaaaaaaaaaaaaaaaa

SEQ ID NO: 160 - protein, 153 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 161 - DNA, 7321 bp, Homo sapiens
ttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 162 - protein, 158 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 163 - DNA, 7370 bp, Homo sapiens
ttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 164 - protein, 137 aa, Homo sapiens
MITPTVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 165 - DNA, 7204 bp, Homo sapiens
gcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 166 - protein, 195 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGWPKTHPGGEQKEGTEASLQIRGKKKEQRREIGSRNAECRGKKGK

SEQ ID NO: 167 - DNA, 949 bp, Homo sapiens
ttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagta

SEQ ID NO: 168 - protein, 180 aa, Homo sapiens
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 169 - DNA, 5188 bp, Homo sapiens
cgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 170 - protein, 180 aa, Homo sapiens; identical to SEQ ID NO: 168

SEQ ID NO: 171 - DNA, 5162 bp, Homo sapiens
ccgctaatgtaccatgccctggtgctggaaagtgcctgagccagctgccccagcggcctcagcactaccaagttggcacaaagctccccaaattcggaggggctcagggaaacgagtggaggggatgaggaggtgaggggtaaacccatcatttcagttggcatttgagcaggtgccatgctcagcggagatgaggctctcccatctgtaggggccgtattaacatgcacactctaaaagtgcccttcgtttctccagcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 172 - protein, 236 aa, Homo sapiens
MVSPDPQIIVVAPETELASMQVQRTEDGVTIIQIFWVGRKGELLRRTPVSSAMQTPMGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 173 - DNA, 4875 bp, Homo sapiens
acacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 174 - protein, 180 aa, Homo sapiens; identical to SEQ ID NO: 168

SEQ ID NO: 175 - DNA, 4539 bp, Homo sapiens
aaactggacattagcttctcctgtgaaagagacttccagcttcctcctcctcctcttcctcctcctcctcctgccccagcgagccttctgctgagctacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 176 - protein, 180 aa, Homo sapiens; identical to SEQ ID NO: 168

SEQ ID NO: 177 - DNA, 4710 bp, Homo sapiens
acacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcgacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgatcttcaaaaaaaaaaaaaaaaaa

SEQ ID NO: 178 - protein, 1207 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 179 - DNA, 5600 bp, Homo sapiens
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacattttattgtatgcctgattaagtagttaattatagtctaaggcagtactagagttgaaccaaaatgatttgtcaagcttgctgatgtttctgtttttcgttttttttttttttccggagagaggataggatctcactctgttatccaggctggagtgtgcaatggcacaatcatagctcagtgcagcctcaaactcctgggctcaagcaatcctcctgcctcagcctcccgagtaactaggaccacaggcacaggccaccatgcctggctaaggtttttatttttattttttgtagacatggggatcacacaatgttgcccaggctggtcttgaactcctggcctcaagcaaggtcgtgctggtaattttgcaaaatgaattgtgattgactttcagcctcccaacgtattagattataggcattagccatggtgcccagccttgtaacttttaaaaaaattttttaatctacaactctgtagattaaaatttcacatggtgttctaattaaatatttttcttgcagccaagatattgttactacagataacacaacctgatatggtaactttaaattttgggggctttgaatcattcagtttatgcattaactagtccctttgtttatctttcatttctcaaccccttgtactttggtgataccagacatcagaataaaaagaaattgaagtaaaaaaaaaaaaaaaaaa

SEQ ID NO: 180 - protein, 1166 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 181 - DNA, 5477 bp, Homo sapiens
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacattttattgtatgcctgattaagtagttaattatagtctaaggcagtactagagttgaaccaaaatgatttgtcaagcttgctgatgtttctgtttttcgttttttttttttttccggagagaggataggatctcactctgttatccaggctggagtgtgcaatggcacaatcatagctcagtgcagcctcaaactcctgggctcaagcaatcctcctgcctcagcctcccgagtaactaggaccacaggcacaggccaccatgcctggctaaggtttttatttttattttttgtagacatggggatcacacaatgttgcccaggctggtcttgaactcctggcctcaagcaaggtcgtgctggtaattttgcaaaatgaattgtgattgactttcagcctcccaacgtattagattataggcattagccatggtgcccagccttgtaacttttaaaaaaattttttaatctacaactctgtagattaaaatttcacatggtgttctaattaaatatttttcttgcagccaagatattgttactacagataacacaacctgatatggtaactttaaattttgggggctttgaatcattcagtttatgcattaactagtccctttgtttatctttcatttctcaaccccttgtactttggtgataccagacatcagaataaaaagaaattgaagtaaaaaaaaaaaaaaaaaa

SEQ ID NO: 182 - protein, 1165 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 183 - DNA, 5474 bp, Homo sapiens
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacattttattgtatgcctgattaagtagttaattatagtctaaggcagtactagagttgaaccaaaatgatttgtcaagcttgctgatgtttctgtttttcgttttttttttttttccggagagaggataggatctcactctgttatccaggctggagtgtgcaatggcacaatcatagctcagtgcagcctcaaactcctgggctcaagcaatcctcctgcctcagcctcccgagtaactaggaccacaggcacaggccaccatgcctggctaaggtttttatttttattttttgtagacatggggatcacacaatgttgcccaggctggtcttgaactcctggcctcaagcaaggtcgtgctggtaattttgcaaaatgaattgtgattgactttcagcctcccaacgtattagattataggcattagccatggtgcccagccttgtaacttttaaaaaaattttttaatctacaactctgtagattaaaatttcacatggtgttctaattaaatatttttcttgcagccaagatattgttactacagataacacaacctgatatggtaactttaaattttgggggctttgaatcattcagtttatgcattaactagtccctttgtttatctttcatttctcaaccccttgtactttggtgataccagacatcagaataaaaagaaattgaagtaaaaaaaaaaaaaaaaaa

SEQ ID NO: 184 - protein, 2322 aa, Homo sapiens
MAGSVKRPMARRPACFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 185 - protein, 2471 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 186 - protein, 1235 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGMKSSLSIFHPGHCLKL

SEQ ID NO: 187 - protein, 2321 aa, Homo sapiens
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 188 - protein, 2003 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 189 - protein, 462 aa, Homo sapiens
MLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 190 - protein, 606 aa, Homo sapiens [sequence omitted]

SEQ ID NO: 191 - protein, 609 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQPSRFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 192 - protein, 186 aa, Homo sapiens
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPR

SEQ ID NO: 193 - protein, 766 aa, Homo sapiens [sequence omitted]

SEQ ID NO: 194 - protein, 648 aa, Homo sapiens [sequence omitted]

SEQ ID NO: 195 - DNA, 40 bp, Artificial sequence
  Single strand DNA oligonucleotide
atgctgtccccggacgatattgaacaatggttcactgaag

SEQ ID NO: 196 - DNA, 34 bp, Artificial sequence
  Single strand DNA oligonucleotide
atgctgtccccgtgagccaccgtgcccactgaag

SEQ ID NO: 197 - protein, 1233 aa, Homo sapiens
MRGLPRGRGLMRARGRGRAAPPGSRGRGRGGPHRGRGRPRSLLSLPRAQASWTPQLSTGLTSPPVPCLPSQGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 198 - protein, 1176 aa, Homo sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 199 - protein, 1233 aa, Homo sapiens; identical to SEQ ID NO: 197

SEQ ID NO: 200 - protein, 1298 aa, Homo sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 201 - protein, 808 aa, Homo sapiens
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQFCRLGSPRSRGCLW

SEQ ID NO: 202 - protein, 976 aa, Homo sapiens [sequence omitted]

SEQ ID NO: 203 - protein, 972 aa, Homo sapiens
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 204 - protein, 454 aa, Homo sapiens; identical to SEQ ID NO: 60

SEQ ID NO: 205 - protein, 464 aa, Homo sapiens
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 206 - protein, 364 aa, Homo sapiens
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 207 - protein, 448 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 208 - protein, 466 aa, Homo sapiens [sequence omitted]

SEQ ID NO: 209 - protein, 233 aa, Homo sapiens; identical to SEQ ID NO: 132

SEQ ID NO: 210 - protein, 393 aa, Homo sapiens [sequence omitted]

SEQ ID NO: 211 - protein, 317 aa, Homo sapiens
MFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 212 - protein, 381 aa, Homo sapiens
MTAMEESQSDISLELPLSQETFSGLWKLLPPEDILPSPHCMDDLLLPQDVEEFFEGPSEALRVSGAPAAQDPVTETPGPVAPAPATPWPLSSFVPSQKTYQGNYGFHLGFLQSGTAKSVMCTYSPPLNKLFFQLAKTCPVQLWVSATPPAGSRVRAMAIYKKSQHMTEVVRRCPHHERCSDGDGLAPPQHLIRVEGNLYPEYLEDRQTFRHSVVVPYEPPEAGSEYTTIHYKYMCNSSCMGGMNRRPILTIITLEDSSGNLLGRDSFEVRVCACPGRDRRTEEENFRKKEVLCPELPPGSAKRALPTCTSASPPQKKKPLDGEYFTLKIRGRKRFEMFRELNEALELKDAHATEESGDSRAHSSLQPRAFQALIKEESPNC

SEQ ID NO: 213 - DNA, 12359 bp, Homo sapiens
tgaaacggagtctctcgctgtcacccaggctggagtgcagtagcacgatcttggctcactgcaacatctgcctcccgggttcaagcaattctcctgcctcagcctcctgagtagctgggactacaggtgcgctccaccacccccagctaatttttgtatttttagtggagacggggtttcaccatgttggtcaggctggtcttgaactcctgacctcatgatcctctcacctcggcctcacaaagtgctaggattacaggcgcatggccaagaatgaatgattatttgtgccttcctatgtgaaaaaaaaatgtttcctctagctacacactattctgttctgtgaggccgccccatcagactgttgacctagagtcccaaccccggccctccaggagacctgcctgttcttagaagcccaacccactcagcagcagctccaaataacagggggagccaacaaaaaagagtgctgctagagcaacaagcaaggggcaattagtcagaaggcaacttccatggtcttccaaaaaaaattgaggtgaaagaccaaagatgtccctaaaatgtcttcctaaaagataaacttcatcaactacctctgactggtcagtattaagaaccactttcaggccaggtgtcatggttcacgcctgtaactccatctactccagaggctgaggcaggacaattgcttcaggccggaggattgcttgaggccaggagctggagaccaagcctgagcaacacagtgagacctcatctctaccaaaaatgtacctctattaaaaaacaaaaaagaagaagaagaagaagaagaaggagaggaggctgggtatggtggctaatgcctttgtaatcccagaactttggaaggctgaggcaggagaatcacttaggctgaggcaggagaatcaccagagtctaggagtttgagaccagcctgggcaacatagtgagacccccatctctacaaaaaaaaaaattcaaaaattagccaagcgtggggtttgtgcctgtagacccaactactcaggaggctcaggtaggaggatcacctgagtccagggaggtcgaggctgcagtgagtcatgattattccactgccttccagcctagactacagggtgagaccctgtcttaaaaaaaaaattaaagaagaaaaaactctcttttcttttctttctttcttcttcttcttttctttttttttttttctttttttttttttagagatggcacgtcaccacattgcccaggctgttgtcgaactcctggcctcaaacgatgctcccacttgagcctcccaaagtgctgggactacaagcataagccaccacacacggccttttcctttctttttctatttctcaatggatttttccaatggacacgtatcactttggtagttatacatgatactagttgtaatctcagccatttttcaacccagcaaatgtctattctaggtcaaatatgtctcaaaaattactaaaagaaaatcagttatgtcctttaacctggctgaggtctggctttgttttctctcatgtaaaaatggagatggcacaaaacaactccaagctgttacttgaaagtaacacctcaggtgatgtcaccagcctgagggagagtgaggttaagttctgaacccacaggcattatatctgcctggggttcacatgccctacactggactggcataatttgagagtcagatccgaagatgtggtatatccgccatctttagcaactttcaaaaactaccctatgaggtcaagctggacctacttttggttttgccattgttgtttgtttgttgttgagggttttctttgaggggcggggagtgcatgcccctgtggagagcactcatttagcttcaattagagtaatgccaaaagtgccagattcctgggaaatcagcctacaaggctcctgcgggaaggaacctccactgccagaagtccttagggcatctaagtgatcagacaccgtcagggattctttgccccgtaaaaacctacttgaccagggacacgtgccaggtaaatttccttcacatttacttcaaccttattgcatactcattttagtattaaaacctttaataaaatgctcctattccttcacactttttttctatgagatctcaaataccccttcttgctattaaaaaaaatcacttattattcaccagcccaatattttaaaagtaaaaataataagccaaggccaggagcgatgactcgcacttgtattcccagcagtttcagaggcaaaggccgaaggatcgctttaaccgaggagtttgagaccagcctgggcaacatgaccagactgcctctctacaaaaagtttaaaaaattaaccgggtgtggtggtgcactgcactcccagctactgggctggggtatcaggctgaggtaggaggtttgctttgagcccggggggatcgaggctgcagtgagctttgattgtgccactgcactccagcctgggtgacagaaggagaccctgtctcaaaaataataagaataataattaataataataggccaaaccaaatacccatcaccttctgctgtgcctcccctttccccaataaatccagtgtcttgctttcaaattttgtggttaaaaaagatgatgagtttctaagacgtgggggctaaagcttgtttggccgttttagggtttgttggaatttttttttcgtctatgtacttgtgaattatttcacgtttgccattaccggttctccatagggtgatgttcattagcagtggtgataggttaattttcaccatctcttatgcggttgaatagtcacctctgaaccactttttcctccagtaactcctctttcttcggaccttctgcagccaacctgaaagaataacaaggaggtggctggaaacttgttttaaggaaccgcctgtccttcccccgctggaaaccttgcacctcggacgctcctgctcctgcccccacctgacccccgccctcgttgacatccaggcgcgatgatctctgctgccagtagagggcacacttactttactttcgcaaacctgaacgcgggtgctgcccagagagggggcggagggaaagacgctttgcagcaaaatccagcatagcgattggttgctccccgcgtttgcggcaaaggcctggaggcaggagtaatttgcaatccttaaagctgaattgtgcagtgcatcggatttggaagctactatattcacttaacacttgaacgctgagctgcaaactcaacgggtaataacccatcttgaacagcgtacatgctatacacgcacccctttcccccgaattgttttctcttttggaggtggtggagggagagaaaagtttacttaaaatgcctttgggtgagggaccaaggatgagaagaatgttttttgtttttcatgccgtggaataacacaaaataaaaaatcccgagggaatatacattatatattaaatatagatcatttcagggagcaaacaaatcatgtgtggggctgggcaactagctaagtcgaagcgtaaataaaatgtgaatacacgtttgcgggttacatacagtgcactttcactagtattcagaaaaaattgtgagtcagtgaactaggaaattaatgcctggaaggcagccaaattttaattagctcaagactcccccccccccaaaaaaaggcacggaagtaatactcctctcctcttctttgatcagaatcgatgcattttttgtgcatgaccgcatttccaataataaaaggggaaagaggacctggaaaggaattaaacgtccggtttgtccggggaggaaagagttaacggtttttttcacaagggtctctgctgactcccccggctcggtccacaagctctccacttgccccttttaggaagtccggtcccgcggttcgggtaccccctgcccctcccatattctcccgtctagcacctttgatttctcccaaacccggcagcccgagactgttgcaaaccggcgccacagggcgcaaaggggatttgtctcttctgaaacctggctgagaaattgggaactccgtgtgggaggcgtgggggtgggacggtggggtacagactggcagagagcaggcaacctccctctcgccctagcccagctctggaacaggcagacacatctcagggctaaacagacgcctcccgcacggggccccacggaagcctgagcaggcggggcaggaggggcggtatctgctgctttggcagcaaattgggggactcagtctgggtggaaggtatccaatccagatagctgtgcatacataatgcataatacatgactccccccaacaaatgcaatgggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccaggtaagcaccgaagtccacttgccttttaatttatttttttatcactttaatgctgagatgagtcgaatgcctaaatagggtgtcttttctcccattcctgcgctattgacacttttctcagagtagttatggtaactggggctggggtggggggtaatccagaactggatcggggtaaagtgacttgtcaagatgggagaggagaaggcagagggaaaacgggaatggtttttaagactaccctttcgagatttctgccttatgaatatattcacgctgactcccggccggtcggacattcctgctttattgtgttaattgctctctgggttttggggggctgggggttgctttgcggtgggcagaaagccccttgcatcctgagctccttggagtagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattccaacccgccctgatccttttaagaagttggcatttggctttttaaaaagcaataatacaatttaaaacctgggtctctagaggtgttaggacgtggtgttgggtaggcgcaggcaggggaaaagggaggcgaggatgtgtccgattctcctggaatcgttgacttggaaaaaccagggcgaatctccgcacccagccctgactcccctgccgcggccgccctcgggtgtcctcgcgcccgagatgcggaggaactgcgaggagcggggctctgggcggttccagaacagctgctacccttggtggggtggctccgggggaggtatcgcagcggggtctctggcgcagttgcatctccgtattgagtgcgaagggaggtgcccctattattatttgacaccccccttgtatttatggaggggtgttaaagcccgcggctgagctcgccactccagccggcgagagaaagaagaaaagctggcaaaaggagtgttggacgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgcgcactgcgcgctgcgccaggtttccgcaccaagacccctttaactcaagactgcctcccgctttgtgtgccccgctccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctggtaagcgaagcccgcccaggcctgtcaaaagtgggcggctggatacctttcccattttcattggcagcttatttaacgggccactcttattaggaaggagagatagcagatctggagagatttgggagctcatcacctctgaaaccttgggctttagcgtttcctcccatcccttccccttagactgcccatgtttgcagcccccctccccgtttgtctcccacccctcaggaatttcatttaggtttttaaaccttctggcttatcttacaactcaatccacttcttcttacctcccgttaacattttaattgccctggggcggggtggcagggagtgtatgaatgaggataagagaggattgatctctgagagtgaatgaattgcttccctcttaacttccgagaagtggtgggatttaatgaactatctacaaaaatgaggggctgtgtttagaggctaggcagggcctgcctgagtgcgggagccagtgaactgcctcaagagtgggtgggctgaggagctgggatcttctcagcctattttgaacactgaaaagcaaatccttgccaaagttggacttttttttttcttttattccttcccccgccctcttggacttttggcaaaactgcaatttttttttttttatttttcatttccagtaaaatagggagttgctaaagtcataccaagcaatttgcagctatcatttgcaacacctgaagtgttcttggtaaagtccctcaaaaataggaggtgcttgggaatgtgctttgctttgggtgtgtccaaagcctcattaagtcttaggtaagaattggcatcaatgtcctatcctgggaagttgcacttttcttgtccatgccataacccagctgtctttccctttatgagactcttaccttcatggtgagaggagtaagggtggctggctagattggttctttttttttttttttccttttttaagacggagtctcactctgtcactaggctggagtgcagtggcgcaatcaacctccaaccccctggttcaagagattctcctgcctcagcctcccaagtagctgggactacaggtgcacaccaccatgccaggctaatttttgtaattttagtagagatggggtttcatcgtgttggccaggatggtctctcctgacctcacgatccgcccacctcggcctcccaaagtgctgggattacaggtgtgagccagggcaccaggcttagatgtggctctttggggagataattttgtccagagacctttctaacgtattcatgccttgtatttgtacagcattaatctggtaattgattattttaatgtaaccttgctaaaggagtgatttctatttcctttcttaaagaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaagttgtgaatgttttgtttcgtttcttccccctcccaaccaccaccatccctgtttgttttcatcaattgccccttcagagggtggtcttaagaaaggcaagagttttcctctgttgaaatgggtctgggggccttaaggtctttaagttcttggaggttctaagatgcttcctggagactatgataacagccagagttgacagttagaaggaatggcagaaggcaggtgagaaggtgagaggtaggcaaaggagatacaagaggtcaaaggtagcagttaagtacacaaagaggcataaggactggggagttgggaggaaggtgaggaagaaactcctgttactttagttaaccagtgccagtcccctgctcactccaaacccaggaattctgcccagttgatggggacacggtgggaaccagcttctgctgccttcacaaccaggcgccagtcctgtccatgggttatctcgcaaaccccagaggatctctgggaggaatgctactattaaccctatttcacaaacaaggaaatagaagagctcaaagaggttatgtaacttatctgtagccacgcagataatacaaagcagcaatctggacccattctgttcaaaacacttaacccttcgctatcatgccttggttcatctgggtctaatgtgctgagatcaagaaggtttaggacctaatggacagactcaagtcataacaatgctaagctctatttgtgtcccaagcactcctaagcattttatccctaactctacatcaaccccatgaaggagatactgttgatttccccatattagaagtagagagggaagctgaggcacacaaagactcatccacatgcccaagattcactgatagggaaaagtggaagcgagatttgaacccaggctgtttactcctaacctgtccaagccacctctcagacgacggtaggaatcagctggctgcttgtgagtacaggagttacagtccagtgggttatgttttttaagtctcaacatctaagcctggtcaggcatcagttcccctttttttgtgatttattttgtttttattttgttgttcattgtttaatttttccttttacaatgagaaggtcaccatcttgactcctaccttagccatttgttgaatcagactcatgacggctcctgggaagaagccagttcagatcataaaataaaacatatttattctttgtcatgggagtcattattttagaaactacaaactctccttgcttccatccttttttacatactcatgacacatgctcatcctgagtccttgaaaaggtatttttgaacatgtgtattaattataagcctctgaaaacctatggcccaaaccagaaatgatgttgattatataggtaaatgaaggatgctattgctgttctaattacctcattgtctcagtctcaaagtaggtcttcagctccctgtactttgggattttaatctaccaccacccataaatcaataaataattactttctttgactctgactcctagaataatctattcaaaaccttaatgtctttttcttgatccttcttttgagtcctaagtaccgccattacagcttcaaattggcacgtcatataggcgaatttcaaagggagatgcaatccacagaagtatagtagttcaaagggttacaaaagcaaggcgctcttaaacagctcagtctttgcccctttgtggcctagggctggagtgcagctctggggtgactcacttgggaatcgggaaggtgttagtctgaatcactaagtccaggcaagccctcagaataggagagagtgttcctagcaaggaaaacaactctccattccaaataatcaggaaagaactttagggatgtggagcttggctatgggaatagaaaggaaccattccaagtgcctattaggccgctcttacctttactgagccagagaatggctctgaaaacaggacagatgccaacttccttc

SEQ ID NO: 214 - DNA, 13447 bp, Homo sapiens
acatttcccgtctgtaactatagacctaacacattatttttagtgggtgtatgtaattccactgcatggatgtattacataccattctcctgtttaatttgttttagttatggatatttagattgcttatagtatttttgttattgagaatgatgcagccacacacattcttgtttatatgcttttatgtgtttgtcttattatttctcgtaggatggatcatgaagagtggaattgcttttcctcttggggcaggcacaccaacagtgtatgtgaggcccctgctcccactccccaggctggccagtactttgggccaatctgctagacccaaaaatgttaatctcactgagatttaatttgcattcccctgactaccggtgaagttgagcatcttttcatatgtttattgacaatttgcatttcttattcagtaaattacctgctcgtatcctagagtcatatttctgtctgcccgtttttttctattcaatttgtgggagctctttgtatacctgggatctaatctttgactcatatatatggcaagtattttctattactgttgtcaactttttatcatagtaaaattcttacatccagcacccccacccctcccctgccctttttttttttttttttgcatttgggttaggcagagagctagctttactgttttccaaatgaagtcaatcgatcccaaggatttttaaattatttaatcagtaaaaatgtacacattttgagggaggtgtgaagatcctaggagaaactgtgctcttgtccctgaagacagactcagtagatctttttttttttcttttgagacaaggtctcactctgtcatccaggctggagtgcagtggtgtgatgatggcacactgcagccttgatctccctgggctcaggtgatcttcctgcctcagcctcccaagtagctgggaccacaggcacgcacccaccacgcccagctaatttttatattttttgtagagacagggtttcaccatgttgcccaggccggtctcaaaatcctgggctcaagccatctgccctcctcagactcttgaagtgccaggattacaggcgtgagccaccatgcctggccaacccagcagatctttaattcacaatctggaaaaaccatctagaggctgttgctctcctagccagtcatgatttgggcccttctcaacatgtgtatgtgtgtgttgtttctttgtgtgtgtgtgtcttagtaaagaggagatttgtaaactaaaatattctcctctctcaaaaatcaccttaattataaaccaaatgctgtgtataactctatcctagcagttggtgattagattgaggcatccatttcagatgtgggtctccttccctggtccacagtgagctccttgcggctgtaccttaacttacctctgttccaaacccacccaggggctcagacacagtaatagatgggtacttgtctcagttcattttgtgttgctataacctaatagcacagactgggtaatttataaagaaaagaaatgtatttctcatgtttctggaggctgagaagtccaatatcaaggtgccagcaattgctgagggccttcatggcgtaccatcccctggcaggaaaaaggaagagagggcaagagatcaaactcctagcctcaagcccttttataattagcattaatccattcacaagagtggagccctcatgacctaaacacctcacattaggtcctgagacaggaataatataaggtggctgcagaataatagaagattttgggcagcaatttcacatgactagcaaaaggaaactgttgaaatggctgcagaggccatgggctaagaccgtgaaaaacagagtgtagaccaagctggctaagacccactgaacccagcatggcactggatttgacctaggtttctcctaggacctcattatacgctcattaacatactaaatcacacaccccactagcatcatgacacttccgagaacacccatatttggtttaaaaataggtggtgtcacagttctgagaaatctccttctttttctaggaatgatcatgaatattctgcctcttggttaaagaaacccgtaaaggtagcaaccccaaaccccctttcgtgtgagtctctcgagtacacccatattcccttttcttgagtgtgtacttttccctttgcaataaatcgtactttcactattttccaactggtctttgaattcattctcttgatggtgtcaagagcctggacactggctggggtctaggtcccactggcatttggggacctcccctccaacactgttgcactgggggttaaacttccaacgtgtttttttttggaggacacattcaaaccatggcagtactgaacaaaaccttggctttgaaaccatatgaagatttgttttgtgtgtgttcacatagttgaagtatttcaacatttttaagagggattttcaggcttctctataagcagactaagaatcagcattagcatgttttctccatgtacaaagtcttttatctttctacttacaaatgaaggtaaccaataaatatttgttgaattttatcattctgttaaccttcagattcagacttgtcagtaattactggcttgcattaaaagcaggagattagagattgaggtccaggaagtataaatgatttgctcaaaggcatgtagagtaaccaggtctcctgtccctctgtcccccttttctgctacaccttgtccctcgacaaagggtgaatgacctagtgatggtcattcatctgaggagaaaggacaaaggtaggactttgaatcggagcaactgaacccatcctggcctattttcacagtcttgccacagaagatctggccaccttagaaggactcattcagtgatcttggtcttgaataataccatgagtacttactatatacaggtacactgctgtgccgtaaggattccctctggagcaaaactgacccaggtcacaggttagtgagggagactgagcctgtcttccacagtgtcacggaagtgagcactaaacaaatactcccaggcatggatcattacaaatggaggtgagtgctggacaggaaaggacaggatgctaggcgagaattcagcaggagggcttggtggcgattagggggctagggaaaagcagaagtggggctgtaaaaggcttttgcaaagatgaaggcttttacatttgtgagggaaataacaataataaaggtgcttggaagggctgctcatccgcattcatgggcctcttcctagaactctgggaatctttctccctagagctctgtaggcgtccagggtcagggctggaaaggccttcacaaatgctaatctgtgagcattttatgggttgccccctgaccctcagcatcctcctccttaactagatccaatggtgaggtgaagaggtgggggcgatggagaatggcatttccagtttggagaaaaaagtagggagaggcggggaagccttcccaccccaatcccagggccaggttcccctctctccaaacaagcctaaggaatgtttttcaaggcaaaatcccacctcactgtgtatttggttgtgaagggggctgtccaggagatcagggttgtttttggagagtttggagggcaggggcaataatgtctgaccccctgcaaacaaatacacctgtaagaaaagctagaccagagtgaagtaaagccaggatttgatggtggcgggaagggaaggggccaatgctgctgctggacagaggggtgttattttccccagaagaatagcatgtcgtggtcatcatcataataatagctgacacaactattatgggctggggacttataagagctttcataactctcaggtaggaggcactacgaactccatttcacaattgaggaaactgaggcacaaagaaacgaagtagtgacagcagctttcctttttcccttcaacagtttggaatcaagctgtttgagccgaggctgggtctcaggaggtgtggacagcacttccatctcggtaaatcagattcgcctgcccataactggggagaatggtggctttgaaaaggttaacttgggagccctggggacggctgcagggaacgtacgcccattccccctaggaagcagagccaggccgcctcctcctccgcagtggtgaggacgcgtggacagtcccgcgggggcggcgggagacctgcggagtggccgcactccaggtccgcgccaaggccgggcagctccgctttctgctcagtctccgcgaggtgtcgccttcggccgaagaaaccaccgcggcgccaccctcgtagctcgcacttatttatttatttattttcaaacaaggggggcgcccctcttctttcaatttgaaactggaaacatccagaggtcttgttcctaagggggcgcgtcctctccctgctattttgcaccttcggactacccttctttcgtaattacacaggagcaacctccctgcaaggccttgctcaacgttggcctcgcgctcagctgcacaacacgcagtcaaagcgggggctgggttagaagcatcggtctcccctccccaacacacacccccggagccctccgtaatttttttttcttttaatgacaagcaattgccaggctcgcagggtgggtgctgcattgcaccgctccgcgcgcagctggttctcagagtgcagccggtgcaagcccgggggtccaaaagggcgggaggagcacaccctgggcttcccagctttgcagccttctctctgcaaagaaaagcaagtggcttttggcgcgaaagccttggcgcctcccctgatttttatggaaatcaggagggcggggtaaagccgctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgaccctcctcgcgcgggcgcccctgccattcccgggaacaggggctcagcctctccctccctggaagaggacgttgtcgtgggtttggaagagcaggggtgggcttagagagcttccaattaagctattggcaggagtatccctgcagcgggtgaatgccgaggggcgtttgctcaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctggggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctggggcactggaccccgggtcgcgtcccctttgttagtgctcgtatgtcttggcctggggagcattttggaggcagtgctaggggcagagaggtcctgtttcccccaagtctctcctcggggtaaagagaaggggctgagagaatgccgttgcaaaaggggtgctctccaattctcgccttcactaaagttccttccaccctctcctggggagccctcctctaggccatcacgggccctcacccggtcccccacctctcttttgcagcgcagtctgaggaataaaattggagaaagttggtggctaaaccgggtgggggtttagggggttgctgggtgcactgcctggacagaaacctgttagcgcaggggtgaaagggactctctggcccaggtcaggggagggaaagacatcccgagaagattcaagggctgtgcaaagccctgtttaaggcgcaggaacttataggagggttgcacagatggctagagccgattttctattctttttctttttctttttttttttttttcaaatgtcggtacctttcccttcccccatcctcggtgggtggtgggctatttgctcctggtgcgtggccagcaggcggcgatatgcgaggccagcaggcgggcccgggatctgaaaggctgggggtggtgggggcaccctccctccctccattcagcagctggctgcaagtgcaacagcagttgtgtacattctcagggggcctcctctttccagtgtgcagtggaaactggctgtagttttgtcttccagcctgaattccaggcctaatttgagatgtgagttgtatctgtaacccagtgcccttgaaggtgagggcaggcactcagcagcctctccaggaaggctcacatcctgggaggactcactgattagttctattgtgttcatttgtctgtgtcttaagctgaagggaagagttaaaaccaagcctttccctgggggtctggatgaacagaactcaacccaaagagtggcattgccttgtccttggagcagggagctgggaccccccttggactttgaaaaccagtgttttcagaatgcaggtggataacaagcctaaatttacttctgggctgaggagagatctttgaggctcctggaaggaaacttggtgataagcctccagtttgaaacggctctgtccctttaatgtctgtgccttgacagcttttggtgaggaagcacttccttccaacagctgtcttcttggcagaaaaccaaaacattggcttaaagggacccacagactggaacagcctcacatttcggctttagaacaaatcccacaattgttcagctttccggtccccttcagatcaagcagaagatatgttttgattttcatgcttgtattttaaacaataattttctaccccagcgtggtagtcaatgaggagagaggggaagaatgcgcacatgatgctacacgtttctgttgttgctgttattattggtggctttgaggagagctgctcccatttgggggtttataccaactgtggattatggctttgtcattaagatttgatctttgttaaatgaaaaactgtttattgtataaaactcaggtttgtggacgaaaagttgttttttttcttcagttaattaaattgttcctcaagtttgtttaaggacttaaaatcaaacacaaccatgtgtaaactgctaaatgaggctcctaaaatgagaggcctcaactctttaagtgtggagctagaaatgtaaataagtccacagggcagactggtgattatgataaaagctaccatttactgagcatctgtctactaggctcagctctatgctaagtctacatgttatctgtcaaagtggtatcatccccatttaatagctgaggaaacagaggcttagaaaggctgggtaacttgaccagggtcatgcaactagtctgcggtggagccaggattctgtctgaccctaaaggccaagttctttatatttatttctaccacctgctaaagtcttgaatggaggctgaaagcacagttggggtatggggaagaaaaatatatatacatacatatatgtatatgtatgtatgtatgtatggggggttgttttgtttttgtttttgataaggagttttgctcttgttgcccaggctggagtgcagtggtatgatctgggctcactgcaacctccgcctcccgggttcaagtcattctcctgcctcagcctcccgagtagctgggattaccggagcatgccaccacacccagcaaagttttgtatttttagtagagacagggtttcaccatgttggccaggctgatcttgaactcctcatctcaggtgatctgcccgcctccgcttcccaaagtgctgggattacaggtgtgagtcaccgcgtccggcctacagatatatttaatttaaagagatctaaaacaaatacaaaactgtccacatctatgttgatggacccataaaaatagcagtctgccagggtctgccggaagagacagataagcatacatattaacatggatatatatgtgaatttcattcaaatggttctcacatgagagtaactagcatctttctctcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaatgatgcaactcaaccttttccttaatggcattacactctgtcccttaaggagcaaccataaataatccataacctatagagggaatttggtttccgtaaatagccctttttgcacctgtacaatcctggttggggggcatgagtcattgtccccacttaaggtggagggaactgagtttggggaaattaaggcagttctccaagattatgcagaatagagatgttattagcgactattgtgtgcattgtagcaatggcatttgataatttacagagcacttctgtatactgtggctccttagtggaattaagctgagacctcagatcagtccctttaaaagaaaagtaaaaatagccacagggttgtttaactcgcttgtattgggctttggtagtattcgtcccattggcagacagtcttctattttaaggtagagcatagtttgtctccaagaattcattgttaaaaacattcactaggatctgtggaggttctaggctaagcagagtaagcagaataaacagatggaaatgggttcctcccttcaatgaactcaacctgattcaccaaagtgtaattcacgagtgacagttacgtagtccagagcaagtaccaggtgcaggagagaccctggggtcacaatggagaccccatatgggtggcatggctctctacttgccattcctattacacagcagtgtcttggctacttgggctgccctttggaaatgggatcaatcttgcaggctccagaagacagagccaagacttgtgtgttaaggagatagtttacctgttgggacataagagccttgcttgtaagcagcttctcagaactaaaagtgtacaaataacctatttctcttttgagtgtcaggttgtactcggttatttctctagggttttgttcatctcagatttttaactgtgagccgaaaaaaaagaaaaaggccttttgcttcactgagaagaaagcaggtccagagatgagacagctttgcttgcctggacacacagtttgtcaggggcagagatgggagacaccaagccatgtgtccttgtctgctttggtcatttttatttgtttcttttgagatggagtctcactctggtgcccaggctagagtgcagtggtgcaatctcggctcactgcaacttccgcctcccgggttcaagcgattctcctgcctcagcctcctgagtagctgggactacaggtgtgtgccaccatgcccggctaattttttgcagttttagtagagaccaagtttcaccatgttagccaggatggtctcgatctcctgaccttgtgatccacctacctcgacctcccaaagttctggaattgcaggcgtgaaccaccatgcccagccgctttggtcattttataaaggcaagtaggagtttagaactcagtcctccttatcctgcttatcgcacacccttgagatacgaggttggtgatactaccatggacatctttctgatggtctcgccatgtagaaaataagataaaatgccctttaattctcctagtccccatccccagactaaaaaataatgcaccctttctttttgaattgtcattcaaaaaacttccgttcgtttgcattttacaggccccaaatcactcacggcctctgcccctgtgtgtgtgcaagagccaaaagaaagttaagcaacctcacattaattgtgtacctaagattcttgaagcccagctcagtcatcccagtttctctatttgtgattaccataaggaacctacctgagtgtgtccaatgaaatggaatgcttaaccgtgaagaaagaaaactgttcatatgaatgaggccactaaactacaattcctactatgctctctttttgctcgggctgctgggaagctcagagccaaattccaccccctctaacatctccagtggtcattctcttctaaatgtttacggtttcttgttttccattgttaggttagtcatctttttaatgtatataatgtagt

SEQ ID NO: 215 - DNA, 3624 bp, Homo sapiens
aatgcgcctgcagctcgcgctcccgcgccgatcccgagagcgtccgggccgccgtgcgcgagcgagggagggcgcgcgcgcggggggggcgcgcttgtgagtgcgggccgcgctctcggcggcgcgcatgtgcgtgtgtgctggctgccgggctgccccgagccggcggggagccggtccgctccaggtggcgggcggctggagcgaggtgaggctgcgggtggccagggcacgggcgcgggtcccgcggtgcgggctggctgcaggctgccttctgggcacggcgcgcccccgcccggccccgccgggccctgggagctgcgctccgggcggcgctggcaaagtttgctttgaactcgctgcccacagtcgggtccgcgcgctgcgattggcttcccctaccactctgacccggggcccggcttcccgggacgcgaggactgggcgcaggctgcaagctggtggggttggggaggaacgagagcccggcagccgactgtgccgagggacccggggacacctccttcgcccggccggcacccggtcagcacgtccccccttccctcccgcagggagcggacatggactacgactcgtaccagcactatttctacgactatgactgcggggaggatttctaccgctccacggcgcccagcgaggacatctggaagaaattcgagctggtgccatcgccccccacgtcgccgccctggggcttgggtcccggcgcaggggacccggcccccgggattggtcccccggagccgtggcccggagggtgcaccggagacgaagcggaatcccggggccactcgaaaggctggggcaggaactacgcctccatcatacgccgtgactgcatgtggagcggcttctcggcccgggaacggctggagagagctgtgagcgaccggctcgctcctggcgcgccccgggggaacccgcccaaggcgtccgccgccccggactgcactcccagcctcgaagccggcaacccggcgcccgccgccccctgtccgctgggcgaacccaagacccaggcctgctccgggtccgagagcccaagcgactcggagaatgaagaaattgatgttgtgacagtagagaagaggcagtctctgggtattcggaagccggtcaccatcacggtgcgagcagaccccctggatccctgcatgaagcatttccacatctccatccatcagcaacagcacaactatgctgcccgttttcctccagaaagctgctcccaagaagaggcttcagagaggggtccccaagaagaggttctggagagagatgctgcaggggaaaaggaagatgaggaggatgaagagattgtgagtcccccacctgtagaaagtgaggctgcccagtcctgccaccccaaacctgtcagttctgatactgaggatgtgaccaagaggaagaatcacaacttcctggagcgcaagaggcggaatgacctgcgttcgcgattcttggcgctgagggaccaggtgcccaccctggccagctgctccaaggcccccaaagtagtgatcctaagcaaggccttggaatacttgcaagccctggtgggggctgagaagaggatggctacagagaaaagacagctccgatgccggcagcagcagttgcagaaaagaattgcatacctcactggctactaactgaccaaaaagcctgacagttctgtcttacgaagacacaagtttattttttaacctccctctcccctttagtaatttgcacattttggttatggtgggacagtctggacagtagatcccagaatgcattgcagccggtgcacacacaataaaggcttgcattcttggaaaccttgaaacccagctctccctcttccctgactcatgggagtgctgtatgttctctggcgcctttggcttcccagcaggcagctgactgaggagccttggggtctgcctagctcactagctctgaagaaaaggctgacagatgctatgcaacaggtggtggatgttgtcaggggctccagcctgcatgaaatctcacactctgcatgagctttaggctaggaaaggatgctcccaactggtgtctctggggtgatgcaaggacagctgggcctggatgctctccctgaggctcctttttccagaagacacacgagctgtcttgggtgaagacaagcttgcagacttgatcaacattgaccattacctcactgtcagacactttacagtagccaaggagttggaaacctttatatattatgatgttagctgacccccttcctcccactcccaatgctgcgaccctgggaacacttaaaaagcttggcctctagattctttgtctcagagccctctgggctctctcctctgagggagggacctttctttcctcacaagggacttttttgttccattatgccttgttatgcaatgggctctacagcaccctttcccacaggtcagaaatatttccccaagacacagggaaatcggtcctagcctggggcctggggatagcttggagtcctggcccatgaacttgatccctgcccaggtgttttccgaggggcacttgaggcccagtcttttctcaaggcaggtgtaagacacctcagagggagaactgtactgctgcctctttcccacctgcctcatctcaatccttgagcggcaagtttgaagttcttctggaaccatgcaaatctgtcctcctcatgcaattccaaggagcttgctggctctgcagccacccttgggccccttccagcctgccatgaatcagatatctttcccagaatctgggcgtttctgaagttttggggagagctgttgggactcatccagtgctccagaaggtggacttgcttctggtgggttttaaaggagcctccaggagatatgcttagccaaccatgatggattttaccccagctggactcggcagctccaagtggaatccacgtgcagcttctagtctgggaaagtcacccaacctagcagttgtcatgtgggtaacctcaggcacctctaagcctgtcctggaagaaggaccagcagcccctccagaactctgcccaggacagcaggtgcctgctggctctgggtttggaagttggggtgggtagggggtggtaagtactatatatggctctggaaaaccagctgctacttccaaatctattgtccataatggtttctttctgaggttgcttcttggcctcagaggaccccaggggatgtttggaaatagcctctctacccttctggagcatggtttacaaaagccagctgacttctggaattgtctatggaggacagtttgggtgtaggttactgatgtctcaactgaatagcttgtgttttataagctgctgttggctattatgctgggggagtcttttttttttatattgtatttttgtatgccttttgcaaagtggtgttaactgtttttgtacaaggaaaaaaactcttggggcaatttcctgttgcaagggtctgatttattttgaaaggcaagttcacctgaaattttgtatttagttgtgattactgattgcctgattttaaaatgttgccttctgggacatcttctaataaaagatttctcaaacatgtc

SEQ ID NO: 216 - DNA, 101902 bp, Homo sapiens
tgcttacataatggaggtggtgggggccgtctcaaaccctggctggggagcagagagagcttaggccacgggagagggcatgcctttgccctgcacgaagctcctggcctgaagctttccttcatccatggaggtggttcattatggtccttcctttatgtgaccagagtcattattgacagctgtgttccaaatccagcttgcatttttaataaggtgtccatggggggaatcctgggcaaatgggaagtgctgtggtctgggtgtctgtgtctcccctgaaattcatatattgaaatcctaagctcctaggtgatggtatttggaggtggggtctttgggaggtgattaggtcatggaggctagagatggagcctcatgaatgggattagtgcccttgtaaatgacaccccagacagcggcctcaccccatctgccatgggagatgaccagacactgggtctgctgggcaccttgatctcggacttcccagcctccagaactgggagaaacaaatgtctgttgttgaggcctcccagcctacaatatttttgttatagcagcccaagctaaggcaggtagccaaaggaaagccaggcttttgtttaatcagtagcagggggtcagtgttcaaagtttagttaaataactaaatgcagaatctcattctccaatagggtacaatcaacgcaaagcccagctctttcctctgcctttgacctggagctgtcccatctgaatttatgctgggggaggacagatcacccaagcttgacaatggttcacatagcatttcatctcccggtatctaggtgacaccctaaaggccctccctctgtgcaaatactcccccagacttagtctctccctttcctcattttgctaaggatagtggcccattttacttctaaaacaagtttccatcattttcaaatcatgatatacttggaatagaatccatacccttttgtccagcccccacgtggaatgtggtctctaccacccttcctgggctgggctcagctgcctcccaggccagctccctgctttgtggccacagtttcctgtcagtttcctcagcacacctggctctgggccccacaggacctttgtacaagacctttggtccatctgaaacaccttctgcccaactctgcaggactgccttcttccttcgcaagtcttggtcaactttccttctcaacaaccaaagcaccgcccctcacacccccttacccccacatcagcttgctggtgtccgccgtatcacccaattccattctcatattttaggcacatttgcaagcctaggaaggtgtggttcctaagagagactttaaatcacaaatatttatattcctgttttttctgcctatggaactgtgaccacatgagtagcgggtgctctgagatgatactttaaaaactagctggccagtgctgaggagggcagagccctgtgaggttaccactgacagagctggggacaaacgcattttaggaaagcaaagaagccaggccaggtcagtcctgggagccactgtgccacgaggcaggggcaacgttcttccagaaaacagtcccagttgtgggacaaatttgaagctgcaaactctacactatagacagaactgtgatcattttattctgaataacttagtgggtgtcaccatgagcataaaaacatttcatcaaatatacacacactgtgttaggatttgagcaatgtcatttcctggaaggttttctgagatagacttcacctgcaggtaaccagaagtttacttgctgtggtgagttgttaggtgaaaccaattatatgtcagggcccagctgccagacaggagcatcttgcttttggagtgtttgattcccctgccactttttgagacagtaattagtagcaggaaactgtcaccagccaactgataatcccctcacatacaaacacaaataatccaggcatcctgtgcacccttgcttatcacggccaagaagtacttttcatctccatttcataacttgattactctatgcctccccaaacagagcataagcttcttgaggccagcgattttgactgttgttctcattgtgatctacccagcaactggaacagtaccggcacgtagaagacgtgacgtgcatttgctgcatgaataaacacatgaacatgatggcataggagaatgctactttgatggggtacatgggtatcaaggattttctttctgctcacacaacatgagatttgtaattaagacacagatttaaggtgagtccggtggctcacacctgtagtcccagcactttgggaggctgaggcaggaggatcacttgaagtcaggagttcgagaccagcctggccaacatggtgaaactctgtctctactaaaaatacaaaaattagatgggagcagtggcacatgtctgtaatcccagctcctcgggaggctgagaatcgcttaaacctgggaggcagaggttccagtgggccaagatcacgctactgcactccagtctgggcgagagagcaagactctgtctcaccaaaaaaataaaagacacaaatttaaaatcacgatgaccagaatatggctctgtttcactcactggaaattatctgatctgcaagataattcttaccaacccctgagtgttttttacagggatgggagtccattgactctctaaaatcacttgcgaagttttgttgctgcggagctgagagctggggccagcctgcctgttgtgcccctccataagactcctggccatgcatttgagcacacctcatgaagggggcaggtggctggccgggctgttatgtgtagcaagcatgtgttctaaattacaattcatttgttctaaattacattcatcatttctaaatttgttctaaatttagaacacagccccaggagacccccttcacccaaccatgttctgcagtcttgattcattttcttacttaaaaaatgctattgataacctgttgctatttctgcctcagtctcttaggaaatgtataaaacagaaaatcacatatcttcaaagctctggagctttacatgatgaagataagcaatgatttctcatttcattctttctcttaatcaactgaattaattatatactcattttcatttggatatgatgactaggcagacttcaagtataaccatccataaccttgcttaatgccatgatgtttggatttttttcaaagagaggaaaaaactcccttggcttctattacagcatccatattttgtgccattttaattttttcttgtgtcttttttctctctctttgggaaatatcagtatcattccttttggtaaattttaaatcaccacttaatttccaatagaaaaaatgttttagttacacctaaaataatcccaaacctcaaacacactgtgagcacaccagaaagtaaaaattatatggagtagaacagattagcccagaatacctcccattcattttcccaggttcctaatttaataatttcagtgactttaatttatcacagaccctcagtctgaactcggcatgagcagggtagacaaccaaacctgaaaattcaagttaaaattcttgtttgggagcttatattatctagattaatcatccacaaggatcaagtcagctaagtaactctggttcagcttaatctctgtggaggcagaattagtcctttacagtctaggtccttgccccagccccatacatttctgtctgcttttttcttttcttttcttttctgttttgagacagattctcgctctgttgcccaggctggagtgcagtggcacaatctcggctcactgcaacttccatctcctgggttcgaacaattctcctgctttagcctccacacatgccaccaccggctaatttttgtatatttttttttttttttttttttgagacggagtctcgctctgtcacccaggccggactgcggactgcagtggcgcaatctcggctcactgcaagctccgcttcccgggttcacgccattctcctgcctcagcctcccgagtagctgggactacaggcgcccgccaccacgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaatttttgtatttttagtagggacggagtttcaccatgttggccaggctgatcccaaactcctgacctcaagtgatctgcccgcctcagcctccaaagtgctggggttacaggtgtgagccacggagcccagactgtttctttcttaagctcttactttctcatgtgtgagttaccttgtaggtttccaaggcagaggggacaagatggaaaaggagaacacagaaatctagcctggaggagctgctctgttcctgtatttatctgtgtaggtgtgaatgagggagaaaatgacaagagaatgacattattttaaggctgttttcccccccccaatcatttactttttgagaaataattgcccaatactgaaaggtatgtcctttcaaaatgttgatgtttcaaatggcttcctaattacctagttatacggggggtgtgtatggttatctgaagttacatgggtatacactggtggtgtgaggtgtccagagagaggaaaggaagagcagtcctggtggctcaaaccctgagggatgtgcgggggatgggtgagaatgtgaacagacatgttggaagctgaatccgtgcagtggcacccatgcctgtagccatctcagtggggggtccttctacgaacaagctttgattaatgatattttaatgctagtttagctttttagcactcccacgcctaaaggctctgatagaagcaaggcccccacccctgcaaaaaaaaaaatccatgatttttacgcattccaacagatctcttaaggggcagacggccggagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccaggtaagccctggtcctttcctctggttttctaaactcttcagctgtggccgagacggaggtgtcatgggctgggagagaggctgggtgcatttttgaaatgcatgtcatttttgggttgcgtttgaacaagctttaccgattgcagtatgtctgcgctaccagttctaagacctgagattgttcctttgttttagaaaaacatcagaaaccctgttttgctgttggttgcacatttggttagggagacaaattctgtgtgtgcttcacaggctttaagatttgggctactgaagcaacgggttcctccagggagcgtgaaaagtatgtttctcaggtttgcccctgtgcccggctcactggggaaggcaggcgcggcagggactctagctgggctctgtacctgcctccaactctgcgtacccgctgtgacctaagagaccttccaagtggggtttccagtcgtgtctgagaccccccatatcctggcctctgtgttggtggcgggggagcggggagagggagagaaggaggggagtgggtacctatttgtgatgattgaggttttcatttccagccaagaggttcctctcaacactctgacagaccgtggggtgggttgggctcctagacaggagtcggctctgattcagtcggctctgattcccagcctcctgcagcagccaagctttgagatgtcagctcagggagaagcgggtggctgggcagggaggtcagcaggcgaggttcccactgggtttccctgcccatgttgtgctgggtcagcaacaagagggacagttaaaatcaacaagcagggcagatgccggtcagtgggcaatcccacacagccaggggtacacgcatgtgaggagacgtacggagagacaggagcaccaccgtcctcttccccagtccccaggccactgctctgtggctctcaagtggcatttttgagacactttctaagcaagagtgaaagtgtaacaaagaagtgaagagccataatagactgaaggaaaaaagggatccaggcatctaaaatagagaatgtttcttgcctggcttaatactctgagatttgtaagtcatagccacttaaaacctttaaagatacattttgacagaggccaccaaaaagagagtgactctggtcaaggcttggaaataagcgttcgttccgatgacagtccacgtgtacccttcacggctgggaaagtttggcgatcctggtggcgattggccgggggtctccactgtacccctccccatccctaagtgggccaggctgtgctgtgggaggattaatttgtgacagcacagttggaggataatcttggaaggaccagtctttgggaggaaaaagtaaatacactttccctgaaatgcttgattttcactccctggccactacctggtttcttgcttttgtgagctggactttcattttgttgggcatacacatttgtgaagcacagacatgtcaggggctcatctttgtttctcaggcatcatggtaccctcttgcctagcccagtgcctgccattgggcggcagcccaacattgctccggagtgcagacagacctggtcttaccccatctcacggagcgcaaaacctacttgcctctgttaaatggggagcctcttctagtcaaagttcctcaggtctcataggcccacagatggaagctgggttacctgacgctcctttctgggtccaagtgagtgcgttttgtggtttccaaagaatagaatttattctcaaggaaatgcccaggaacccagcttcaaagactcaagcaaatctgaaattcaaatacaggagctgtaaacaggatggtgtttggcagacagccttgctgcttaagtggctcagcccctcagctgggctcagtttcccctcaccctcctcctagcctgcctagtgactgcctgcatgcctcaattatcctggatgacacctgcctgctcgttcctttgatgctgtttgaggctctgcctaggtattccacccaccaatagtatcattaattaacttacattaagcccacttagcacattagatcaattaggggacaaaagccccagccagcctttcctgtgagtatgccgcctccatctcaatgcctacgattctgtccttactgaattcgtatattgcaggaaggaattttttttaagtcccaaagattactattttcctaaaaaataaagcaaggaaacataagctgatgtctaatcatttaacctctgctgtacatttctatggcactttacaaagcgttgtcatgaatgtcttctctattttcccaataaggaaattgaggctcagagaggttcactgtcttgcccgaagtcccacagctcataatgattatgggaacaccaagaactggtctaggttagcactcagtatgcccaggcctcgtgtggagcctgtcactcataattggaggggctgagactagaacctgtgtcctctgcctccaacactgacacatttgcccccacaaggagatggtgcaatgacagccaccagggattataaaaataagagtggagtaagcaaacactccccctcctgtatcttagtttcccagggtcgtgtcagccccagacacactcatctcctgtcctcagaggcgagggatcaagaggaaacagtctcagttttgttctttgtgaaccctcctgataaaagttagagtgtttgtagtttttatatagtgaaaaaaactgtcaaatataggccattgtaggtggttcagtctaagatagtctagtaactaaaaaaaaactcaaaatggcatttggggctcaggcatcccaacagcccactggcccctgagacaaatgagcttgaccatatttaatttttcatcattgcccttagagtgtcacaaagcattacccaaggatagctgaccctgtacagtcaaagctatgaaaaaagctttgccctgggtcttggcagggatcagccattcattaggtcatgtattaagggatcctacaacctgaagtgtcttcagtcatagcacaccccaaggacatcatgcactccatgaaaatatgtccaatgaatgaatgaatgaatgggctccttcatccttcttgtcagagaaaggtcaccaattgttccaatgacacagttagggacaagggggctgctcaaacatcagcatcccctaagtcaataagcaaacaaatcctagttagcaaagctaccctctctgggggcagagacacctgttatttctcaaatgctggatgcccaagggtggcaaacacactgtttggaccccaggaaggagcagacacatgtgggtgaagctggaggtcctgcttccttgcccagatcctcttgcccagacacactctggaaatgcccatcattttatacacctacgtacacatgtaaccagccaggatgcctttgttttccatttccgagaaaacagaggactatggaaaacaggtgggccgtaaggagccctacagaggaagatgcacctgtggcggtagccctgcctgcaccaccctgcgagctcatgccagcttaactcacttcacggtcaatcagacctactgctccaaacacagtaggaaggcgcgccttcacttgtgagtcggacgaaatcagcaatgagggcaataacaaccacagtcacgttactcttagtaacagccctgaggcccgcagtgtagcacagaagccaagcttagtggtgggcttaaggctgatgttgttaactgataccattcaatagctagatataggcaactaaaaggtgagcccaaatactgaaataagatacagtattagtctcctgaaaataaaaaagagttgattctgccaacaacaccttaatcctgagagaaagcactttcttaggatagaagaaagacatgcaaaaccagactgcaagcaaaaaatgagagggcatgcactgttttgacgactctcagatggttaccaaatctcttctcttaaaacttccatttgccatatttccaatcccatgtttgcacagaatcctgcatgcacaggaggaagcaggcaggatttcaagttggttttagtgcacattcattcattcagcaaatgttttctgggcatctgctacatgccaggcaccatgctgggatgtagtgagtaacacagtggtcccatgggtgaggagagagaacatccctgcactcacagagcttagattctgctgcagggagagaagctataatgcataaatccagcgccatgaaaaaaaaacaaacaaactagcagggcaggtagaaagaaggtgcccagggtagtagtgggggcctcttgggaaatgaaatagttgagtaaagacctggatgaagtgagggagtgaaccaggacacccgcaagaaaggaggccctggggtggggtgagctggagatgtcccagcaccagcaggaaggccatgctgccggagcagagggaaaggagggttgaacagaaggagaggagaggagaaccaggagcctgagcgggccgtggcaagggggctgggctctcattgagggtgatggaaaggcaaacagaagtcaagtcagggcggaagttcagccatggtggctcacgccctgtgttgttctgggacagtcagtgcccacaccaccccatcccatgccacgccggttgctgtaatttgcttctaaggagctgggtctccaagtagcctcttcctgggagagttggcttggctgaggtgcagggcaggaagggcaggcagcaggaagggtggcaggagaggaatgatccattttcaccaacacctgctcccttggccgttaacacatgccaaagggatccattctgagaaaaattatgaagaccctaacctgaaacacatgattacacttccaaaaatctgaaagtagattatcaagactcaataagttgtgcagagaaagaacacttagcaacagacatcgccgtcgccccccttgcagccctgctgggacactcccacagtcgcagagccactggccagctgcactcgcttcctcctcacttggagagagggacaccttccagcatcgggtgtgagatggagtggggacgcagtggctctctgatggctcagttggcaaaattgttggagaacgggttcagagatcactgatgcccttggccagcatgccagacctgttcctgttgactccatatggcctttggagttggagagaaggtggcttccctgccccgtcccgcacggagccaccagcacctggaaagtttgatttccttcctcgtatctggaagatgcaggtcgattaggagggaagtcagtctggaggaggatacctgtctctgggaactccagggcagtcaaggcagacagatggatcacgagggaggagctggaagggcgggattgttgacttgatgtctggttggggtctgatgaatacaggaaagtggaaggccacggggaatgctccagtgggatgcagatgtctattaagttggctgattttatttacccagttagatgtggttttatggtttactgtttggattgaggctctgtgtccttgggtaataaacattacctctggccccaaaaaatcctaatccttaaaaatatggaaatgcactgagcatccctaaaaggtactttagaggagtctcaaggttcattttctttaagatttagtccttaataaagactcaaaatggctgttcctaaagcctcctgtccataatgaagaagataaatcagagtgtacactttggggatgtgtttgttgacatgcggcatcctctgcagaaagcctgtatctccaagaagcgtggccaagggagggcactgacagctgagtttagagtgggatttgtaagcagcacaaactaattgtgcatcggtagatttgcagagtgtggttttctgttgatggatttctttatgggcaataaaatctccaataagtaccatttacattcagcagaactctttttgaattttagctcattcttagagagatttggagagagagagaccatccctgcacatgcagcaggcacctggcctgtctgggtggccagtccttgttctgtggccactgtgaaccccgccaatgtcctagtttcccgccagcactcactaagcaattttgcttctcattttacgggcagacgtaaccaaagcaaggagacttaggtgactcgggacactcggttttgagtcaattctaaaaaccaggagaccaaactttctctagaattactgccagttggtttccaaattgaggtttccagatgaaaattattatccaaacagaccacacacagcactctgacttgccttctgtgcctggcatgtgcgagggaaatggcgctggagaatattatcctgatgattatcacagttgttgcttttgaaggcaaatatttattttgtgaagattgcaaaatgaagtacaacagaatgttgagctcctccttatgtttacagaataaacagaactgagacactggcaaacgccaatgtccctagttcttaaaggactggctgcatgcctcccacggcatcagttaaagcaggagcctctggagatggaggcctttggtggcaggacagcctcccaccagggagggtctgaggcttccacccacctccctgggttcatctctgtaaacagctctcccagtgtgggctggatggggtttgaggtggctgctttcctgtttaccctggaacatttctttgttagagaggccactgcatttgctgtaagacaacgggctctagatctttctcaaggctttgggagatctaatagaaataaaagacctggcccctattctcatggcctaaagcattgaaaggaggaaataggagagatagccaaattgcatggtgctgttactgagccgttaaacatctgtccctgccgttgcactgactgtgccctctttgaggacgggaagcatccgtctgttcattctctggcacctagcacagtggctgcacacagtaggtattcaataaatgttgaagaaacccacatttattgggcatttgttgcttccttagcgtttccgtcttaatctgcacagcagtcctgtgaaatagagacaatcatcactgcttcacacatgtgcagagtaaggcttggagaggtgaggtggcttgcctgagacctccctcctggtaagttcatggacttcgccttgctgtcgtttccatgggctcgttcagaaatgagagctgggatgatgtgggctgtttcaaattagcttgaagtctaaccttgtatcataactatctcgggtgtggggatagtatatatcgagcagaggtctaggtatagacagatgtgtgaaatgctaaacatggctgaactccccagagacacctcagcagacagccctgctggctagccccggatcctggacaggtgttgtttgggctgcaggatgctgggagctagagcggaaaatggaagcttctctttgtatccccaaggccaagagcagacctggccagccattcttctcacaatagcagtcataccagacctaagacgcgccagacaacttcaacctcaggagcctttcttcttccctgaagttggggtggactggtcctggtggggttggactggcatgggctagccacctggggcgggtgcggctctggaaagaatgctggcggcagggtggggaggagcccagcctcaggtggacacaggcccagagccagccccttcccgtgctggtggtggaacgtcagatcatcattgctgggtaacttctgtcacttcagttccccgagggaaggtcacatacttgcctcatgggaatattatgtggatttccgagagccaaggcaggcagagtgcttagagcgggccgtgagcacattggaagtcctgctcatgctctgtatgcactcacgggctgagtttaacgggtcagctcaacctctgcctggcagtcattcccacggtctagtccgtcagaggtccctgtctttccttggagcagtctatcaatttggccaggtttcaaaacaccatgaggaccctgcagttaaggggcagctacacgggggttggtgtggggacacagcaggctctgccagcccccatggagtatggtgccaggttggccacctccccaccagtgacaccgtgaccccactctggccacactgattcaagctcagggctgccgcatttgttccctctgcccaaaacgcgctggcccaagatgtctgtgtgtcttgctcattcccttcaggtctatgctaacacgtcgtcttatcagagaaaccctccctggccccacactgtataaaacagcagctcccacccctggactcctgttttacctttatccataacagtgtccactcaacgacttatacatatgcatgtaatatcacataaatatatatatgtaaatatatacatacacacataatatcacataagtattatatatatgtgaatatatatatatttgaacctagaacttggtgagtaataagtattagtttaaaatcacgacttgctgctgaggtgagcggcagggcgtgcccaccagagcattagtggcagtttcctccttgctctccagagcctcccaagggggcttttgctctcctcaccttcacagaggtttcgggatgtgactcacctgggcctccctgggattctctcactgcagaactgtccggaatcagtgaagcaaatagggaagagaatgaaatgagctggggttaaagaacaaccaggagaccttgaaatagtaaagtatcaggttgagaacagagaaagtggtgagtgacttgcccagccccccacccgaccccaccccaccccaccccacaccattcatttgaacttgacgatgggcgatctgttaagtgtgagtgtgtccatggtcactgatacagcaagcttgagaggtgaatgcatcacactgattttcaagtgaagaagcagaggccaggagactcacttgcacacctcatctcagccaggataatagagccacagcaccctgcttcccaccgcccagcagtgatgccaggtgtcccccctacccgtgtgctgcccgtcagagccaggctggctgtcagggcctagcaggaagcatgtcatgtcagatggccaaagtgaagaaactctattcaagggacccatttggctggtgacatgcgcctcagtggctcctcctctgttggctactgctgcctggacctgctcaagccctcctctcctctgcagttcctgccatctgcatccttcatgattaatctgaccctgggtagggaggcaggaggggcttctcttctccacagccctgcacctcagcagcatggctcagggtctccaagtccccagccgccacctgacatgcccctagcttactagcttgctttctccagcccccacttcagctcctggggtgtgccatgcgtgtgtgtgtgtgtgtgtgtgtgtgtgtgtgtgagagagagagagacagagacagagagagagaaagagagagagagacagcaaccaaagcttgggatggggcttggaccaggctgggggaagtggtggggcagggggcagcccagggtcagccccagcaaacaagagtgttggaggagtgaggttcgccaaatggaagaggcaaatctgactaaacttctccaaccagatgacacctttaattctgcatgtctgggctctaagacgcagattctccttttacccaacagcaagaaagagctgttccttaagtaagggtcaagtactcgggcagtggatggagaaacacagtgagaggaggggcagccttggcatcctcagatgtttccacgtttccgaattttcagtgaatctggttttccacaacactgaatgtttttgaagctggcacctctctgcttactgagtagatgcctaattggaaatggaatgtctgtacttcacacactacaccccctcctgcccctgctgagaactttcccgggttaatggtttccttttggaaagctttcaaatggtcttcgttggagtttacattatctgcttccctctgctctgtatgtggattatttgcctgttgggtttaatttaaccagatttgcagctgtgctaacaacttcattggtgccctcctgctttcagaatggattttcccgtcttttctccagcttaccgatagactgtctccataccaaaacctgcacggggttgggcattgtctgctggtgttctgcctcactacagaacctgtttcctctgaccaaacttcactgcacctcaggttctaactaggtctctctaatattttaatatgaatagttaaaatgaattatttattaaaaatcactgttaaacaagaaaaaaaaacttttcctcggtgctctgaacctcagcctccttgggaggatctgcatgttccctaagcccgtggctccctcggagctctaccctctagaaatacgttgcaaaactcttgaggcgtctaacaaatatgacaagcccacagattagcaaagacacgcagagtcgaccaagtttgatatttttgtttttttactgagctttttgtacttaataggagacctggccacctaataagatggtgattattggaaaccacagagatgtaatcagatgttctagacatggatggtgtatttaaccccttgaaacacttccacgccctgcctggatccttttctgcttcatagaccaatgatgagttcctaaaagatatgcacgtctatccccagtgaaggccgtagctcagcaggccctgtacttggcattacaggggcgggacctgtgtagccttgccctctggggccctttgctggtcttcctaccctgggctcttccctatgtcagtgccatttgtcgggagaaggaagaacgactttgaaccgcagccctgttctgtggatgaagttggctggagttcctctacgagaatagaagctccctgaggagtttcatctgcatccacagagtccatagatcctgcctatagataagagaataagcaaatggctgttgtttctttactgtgtcatttaatatgatgtcttgtggttgatgaaggcttaaaaagtgtgtgaaccagaagtagaacaagaaaagagggtgcggctctcagcaggaactgtcctgaggtggctgtgggtccttcagacactgaggcctgtttccaccctcagctctgaggccttctgttcactgaggaatctccagggctttgtcagcatttgaaacaacagtgactcctagtgagagccgggtcccaggagggaggacgtccagatgtccccagtccctcctcactccaaggaacagtcttccacttcaggaacactcaaaaaaggcgagctcctggccaggctcggtggctcacgcctgtaatcccagcactttgggaggccgaggctggcggatcacgaggtcaggagatcgagaccatcctggcgaacacagtgaaaccgcgtctctactaaaaatacaaaaaaaattagccaggcatggtggcgggtgcctgtagtcccagctacttgggaggctgaggcaggagaatggcgtgaacccgggaggcgcagcttgcagtgagccgagatcgcgccactgcattccagcctgggcgacagagcgagactccatctcaaaaaaaagaaaaggcgagcttctcaggagccaagctgagaggccaccagatctcccggcggcaaaggcagtgctgatggtccatggggtggtcaggggtgcagggcctgttggcaccctttagccttagccatctaggaaaacccaggcccgggccagtgggggccactggaatcatcagtgcctccttattggcgtcctgatcacagcacaggtgtctttctaaatgagagcttgttctttccaaactgggaagtcagaggtatttggggcaccctcagacaccttttcatcttagcatttgtcagtcctcactgtgcacccagatctgggattctaatgccaatctccagtgaaaggaaccaggactccttggagaagtggctgactccagagctggggcagggaaaatacaagaggagcctggagcaccttgtagtgccagaaagtaaagaggtcctaagaaaagaaaaagaagaaaaagaaaaaaaaatggtagtatgtctaagggacacacaaaccaactaaaagagctcccagtcaccatagctgagacaatttgagcaacaaaataaataatgtaatattgggttataacccagagtttaaaataaatacccatgtgttcacactgacaaataaataatggacggatggacaaatacataacagagaagaggcaggtctcccgtgcagaggaactccaggtaattcatgtagatgctgtgcccttgaggaggttaaacggataactccctcccttaagtgtgcgctccgcctggagacttccttccaaggagcaccggaaggagtcacttcagagtggggaatcctgccagtcactgcttcatcccagtgatcaaggccagcatcagcaatcctgagccatgctggtagcatggacccttcatgtgatgagaatggcacattgcctctgtggtcttcctctcaaacccatagccccagtctgtcacgagaaaaacatctgacaactctcagttgaggaggattctacaaaacacctgtccagtgctcctcaaaacttctgagtcatcaaaaacaaggcaagtcagaaattgtcttgttagccaagaagagcctaaggatgtgtgatgattaaatgtaaagtgggatcctggatgggatcctggaacagaaaaagaacgttaggagaaaactaaggacatctgaagatgtatgaacttcagttcaccagtattgcaccagtatttgttcatcagggatgaccactgtattgcatcatgtaagatcctaaaaggaaaactggtgtggggtccccgggaacactctgtattgaatttacaacttgtctataaatctaaaactgtcctaaagcagaagaaatcccttgtctagatgattcagtcaccctcctctttgccctgccctttccaccatccacagaacgccgtccagcagttgaggggtggccttgacttctcgagctcgttcaggagtgaccacaagacatcctgatgccgcacggagcctggccgacagtgccacccttctcttgctggaccaatgaatttgtgtcctcatgtcatttcctccgaccaccacagggctctggccaggggcttcgcaagctccttagctcccagaccgcacccctgttcccccggctctattttaggcttattggtgctggctgcctccccaaagctgctgccctgcttccagtgctggggtaggaatgagctgagcctacagtccacccacccacctcttctcactccggcatccatctggtcaccaagctaccgcgggttgacccaggctagggtcccaggttaaagtagacgcaggtcttgctctcatgtgctggcgctatccatgtctcgccggcccatgctccagccctctccctgatgctgtgcccagggctgagctgcacccacaagctcccttgcccccagcctccagctggatttgacccatagaagacacgggtgggaacccaggcaggagcatggtggccggcaggggatttactctgcacctttctgcctgaggccgcagctgctatccctgtgttcagatcctctctctcctttgccccttcccacacaggctggactgcagctcctggagtgctgcaccatcatttgctcccctttggaccctgcccagcaccctcagacagggtccctgctgcactcgccccaggtggcacttggggctaggctccgtggaaaagcagattccacaatggggccgtggtttcccaggccaggtagaaaggcagtgcttgctgaggggacttgcagaatggctgcctgagaggctcaggggttgatgggctcttccttctgactcctgaatctccaccagagccctgcacacctcagaaaggctagagctccagcatgcagactgcaagtgttgtgggcaggcctggtgaggcagctcggggtggtgggaagagctagaccccagctctgccatttgctggctatttcaagttccctctaccctctcagtttcagtttcagtttctttatctgaaaaatgggaatagtatctttttttttttgagatggagtcttgctctgtcacccagggtggagtgcagtggcgctatctcggctcactgaaaccttcgcctgccgggttcaagcgattctcctgcctcagcctcccaagtagctgggattacaggcacacaccaccatgcccagctaatttttgtgtttttagtagagatggggtttcatcatgttggtcaggctggtctccaactcctgacctggtgatccaccccccttggcctcccaaagtgctgggattacagacgtgagccaccatgcccagtcatgtctacttttcatggtgtaatcattaagataatgttcataaacagggtaccatcgtgtctaagacaaaatacacagtcaatatgtggcatttctttttttttttttttttttttttttgagacggatcctcgctctgtctcccaggctatagtgcagtggtgtgatctcagctcactgcaagctccgcctcccgggttcatgccattctcctgcctcaacctcccaactagctgggactacaggcgcctgccaccacgcccagctaattttttgtattttttagtagagacggggtttcaccatgttagccaggatggtctcgatctcctgacctcgtgatccacccacctcggcctcccaaagtgctgggattacaggcgtgagccaccgcgcctgaccaatatgtggcatttctatttttcttattatttctatttggagaatgaatggacaggatggtcttactctcctggaagtggattgttgagccttttgtgaacaaaggtgatgcttacagctccgtaattggtttaaaatgggtaagagccttgtgctgaaaaccctgtgatcctcatcttgaatcccaagaaatgttgttatttacataaaaccaaaagtctgtggggcattcaaaagttgaagggcctttgagaactctgatgatgttttcgttattgtgagatggaagccaagcttgtggctccagccaaaaaatttccaggttttgtagtcggtgtggaggtcagaacaggcagcggtcaccatgtgtggcatgggttctaggacacacgacccctggaaagtgcatttctccttctgttcttccggaggcagccagcaccctgcagatgagggaagaagtcattgaggattccaggagccacactcacaggctggaaatgtccatggcagtcaagaaagaaagattctgccagggttcaggcccttggcatcctcaggtactggaaagcactggaaagcaggagaaatgaaggcaggaggcagccagcactgcactgagcccagacctcccaggtctcaggggctgatggcggacactctctctgcaccgccctcctgccctagccagccccctgagtcagcttctaatggtctgtctcacaacttgcagggaggcggcactatacacacatgctgaggccaggtgcggtggctcatgcctgtaatcccagaactttgggaggccgaagcaggcagaacacctgatgtcaggagttcaacaccagcctggccaacatggtgaaaccccatctctactaaaaatacaaaaaattagtgggacatggtggcgggtgccattaatcccagctaatggggaggctgacgcatgagaggtgcttgaacctgggaggcagaggttacggtgagctgaaattgcgccactgcagtctagcctggatgacaagagtgaaactccatctcaaaaaaaaaaattcaattaaaataaataaaaaaataaacacctgctgagacctcttcctaagaaattctttggacttggagcacaggttgccttgttctgggcgtgcccagctcagagagctctagaagaaagttcaagaaggcaaagaggagaatccagctagccaaggttggggaggttggaggaagagtgaacgcccctgccggaggccccccggtcctcacccccttctgagtctcagcatctgcatgggctgtgagccattgttttgtgactgacaaatcagatgagggctgcttatttttcaaatgatcacgtcaagttctctgatcacagccatagctacaaggcaagcagagtggggaagacacccgtcacccttgtgcagacacttgttttaccaacacttggcgtgcagggcaaggcaccagcttctgaacccaggtcacctacaatctcttttttcctaggctgcctcggcccgttgcagcctgaccttgccctgccccggcactcccacagcgggcaggattggaaagggcagtgtctggcacgttggcatgaaagccagccaggagggttgggcaagggctccagggcccgtgaggaaggagtggagaccacaccatgcagtgccctgcccctgttttgatttggtcatcattgtctgtgttcaatcctaagcttgtcgagaactgggccggcatggctattgaagttctgtggaacagaagttggtctcttacaggggtgtggctgaaacagcaaaggactggaaggcgtattagtcatctgtgctgtgtaataaatgactcccaaatgtaactgcttaaaacaacaaatgtgaccatcccacagattttgagggtcaggaatcagggagcggctccgctgggtggttctggctcagtgtccttcctgaggctgcagtcggctgggctgcaacatctgcgggccaggccaggctggaggacccacatccagaggcctcgcaagtggctgcggcaggaggcctcagctccgggccacgggagctccccacggctgctcctctgttgcccctatgtgactgagcagcagccacggcacagcaggaagctcagtgcctttggtgacctggtctctgtaattgcaccgtctcttctgcccttttttctgttggctagaaacgagtcactaaaatccagcccgttcacacagggagaggaattaggctccaccttttgaaggtggtatcaaagagtttgtgtatgtgttataaaccacaacacctgacttctaatgccaactcctctttaacttctgtgtaaccttgggcaaattgctctaaatctctcagcctcagtttcttcttccataaaatgagagagctgatcctatctctaatacccttcctctcagccctcacaccctcacaccttcattcattctgggtatttatttactaaacatttactcagctctctgctagaatgcctggggagtttcaaaaagactgatgcctggttttaagtctcccctagtgatgctactgtgcgggcagggttgagagtcctccttctggagtcataatctgaaaatgtgatttgcacgcaaatcacctgggggtcttgttacaatgaagattttgatactggaggtctcgggtgcggcctgaaatttggcatttctaacgagctcctgggtaatgcagtgcatcccagggaccactctttgaactcctcagagccagtttctagatgctggaagaaaggcgcagaaatataaagatataaaaatataaagatgattcccaccctcatggaacaaggaatccagttggagacggaaaacatgtagccagcaccatcagggtctgaccgcctgcccaggatgtggtccaggcaccaggactgagtcggagggggtgaagaatcccccagtgagcacggtctcgccggaccctgtgatttccccaccaccagcatcatcccctgtcccctcaggtccacagcaggacacagcatcaatccagatccttctgtgatctttggaagtcttccacaaattaggttgttttgctgaacggtagttatttccacagggaaagaaaagaattagcaaatctatcacttgtatttgttcagtcctgtagactattccccaggttaaacatttgtttagtgagcctgcttttattggcaccacaaacaaattaaagtgtattttccgaacttatcttcagggtgtaaaattccaggcttatggaaattctagtaaaatagcttttaaaaaaccatcatcttagcttttattctttctaccttatggtttttctgtcttctccaaagggccctcttcccatcccctgagcaggaaggaagtgaagtattcccacaaccttagaccttggtcccctgccccaccctggttattctctgtgtggcctgcctgcaatcctgtccacctccctgcccagtcaggctccctgggcaccgtccagaggccccagctcccagaccatctccactcagtgtcctgccctccttgtgtctcagtataaccaaggcaatgtcaggatcctcctcacttcatatctcagcctctgaaacagactcctaggtgaactctgggctcccaggttctcttcttgctaacctttacacaccatttgcagattaatagtcctgaaatatttcctgcatcctgtcactgactccaaacatctcatgtctcctggtgtcgtaaagaagcttctttaactcaaatgcgtaccacctggggttctgctaaaaatgtagattctgacccactgggcctcgggtaggggcctgagattttccagctctgaggagctcccaggcgatgctcccctctcagtgcaaagctcaagcagcaagattctgcaggatgaggccacactacccatccgtcattttccacaggggaaagtgtcttcttagccagactcatcacgtcatccagatagccaaggctcagacgtcaccaaagcctgtgctgggctggctagaccctccattagcaatttccccacttttaactgtgtttaaagaaatctgagttgtatgttcttatgacccagattgaactctggattctcctgaagccttctctaactcagtgattctttcacccctttttggatccctgcacaagttagctcttcattgcacactgccttgcgttgttattaatattttgggttttcttcttttacatgtttctgtctttccagctagctgctgaagcccctgggactgcagctcacactcctttcacttcttttatatttctttcagcactgagatggtgctgtgcctttagtaagcacttaataaatatcttttctttaaatgacccaaagcaaaattcctgtacttaatgaaaaattagtttgagaaataaagggaataaaaatgaaattgaaacagaatgacccccattttacagccctccctgaatagcatataaaggtctgcttcatgccaacatcctcactgagtcctcggggccaggacctgtatgcctttggaggcctggcatggtgtctggccccataaacatttgaaaaatgcttgattcgtgagttcattaatcgttctcctctcaccggagatacaaccatccgaacttagccagcacatacagatcaatagcagcaagaacaagaccaagaaagtgggtaatttcaaataaggtcttggaaagacagaatcaaagtgcatatctaaaaataggtggggtggaggttggagctgagggcagagagaagagcaggaaaaaaaaaaagaaggttgtcaaagccagggttcagctgctagagatcaagaccagccatagagcagaggtgccttctttcttcatcacccttgttgaatccaattctcaaggagctaaaaccatgactgtcacacaacgtaaactgactgtgcatcagggactcattcagctccttaatgagggatcccttgaggtggccttgctgattccgggagcttctgaggaatggaataagttaggataacaaaactgcttaaggtcccacagagcagtgaagtcttacaatctttgtggttgtcttttttatcaggctaaaatctgcaagctaacatgtaaccctaccgtgactgggctttggccaaatagtgcatagcagagtgaagctcaggtacacgcccctggagatgacatcatctcaggcaggcctgagtccctggaaagctagtttccttccacatgaccttatttcctagtgttcgatggctttttgtatcagcatcaagctttaacccagggctacccagagtaaagggggcaaattctgtgcacagcagtgcagaagaaggtgccagctcacttcttccctggtagctaggaagaaaagagaacaccatgcctgtgatcaggaggcgccacagacagactggtcacccatgcagccttggcttgccctctgagtatgcctaccacccttctgctccaattctcaacaagccagaatatttctgtgggatctgtgttacctcatcctggttagaactgctggggacaaacctccccataatgaacagaaaatgctacatccctggtttgcaaaacttcaacagtcaaaaggatgcatgtacaattatttttctatagggatgcataatccaaaaaacaaaaaaaggcttgaagacctatgagctaaaccattccatcttaaatgttgaagtatgtctgggtcagctctgatttagtagatctagggggctccaggttcttcatttccaacaggctctctggcgatgctgatgcagctggtatgtggaccccactttgagaagagacagtttccactaaagtgagaacaatgacggcgccttccccaggtggtggctgtgaaaatcaggtgatattatccctgtgcagcactcagctccatcccagggcctgggactgaggcattcttgggacagtgggcgcatgtcctatgctcaataacacatctctctatgatctctccacgcgtcctgttctgtgtgcatgagctgttttctacccctgtggctggggccctccagctccgcaaagccggatttgacaggtcttagactcactaatcttgagggttttccatcttttgtttctgtgaagtcactgctctcaataacattgttacctgaagagaaatttatcttggtgggttcttactttccttttaaaaaatatccacatatgaagctctcaaacaagcagaaatccaccgtctagtttttcccaatagactgtgttattggaagctttgagggataaggggaaaagaaattggtttatgaagtaaaattgaagcaattaaaggatcaaaatcaccttacattttcctacaaagacacactctgtcaggcatggacagccccctgctctttcaagttttatagccaccccgtcttggcagaaaaattaggaagtcacttgttgtgcacaagactgttgtaaacctctttgataataaaaaaaggataaaaagacaagtaggagacccgtaaacacgaactttaaaggcctggagaacagcaggcttccccttcttctgctcctgctcttagcccacaagccctcaaaccattttctacagcacatttgctgcagcctcagggagaacatgaactattgaagtaaaaaaaattctagcctttgatattcttcatgtttttttcctgtttttccctgtgaaatatgaacctgcaactgattatcccagggacttgatctcaaaaacataatttggccgggtgcagtggctcatgcctgtaatctgagcactttgggaggccaaggcaggtggatcagttgagggcaggagttcaaaaccagcctaaccaacatgacaaaactccgtctctactaaaaatacaaaaattagcctggcatggtagcgggtgcctgtaatcccagctacttgggaggctgaggcagaagaattgcttgaacctgggaagcagaggtttcagtgggccaagactgtgccacagcactccagcctgggcaacagagtgagactccatctcaaacaaacaaacaaacccatgcacaattggctggtctttgggacaaaccccagtaaagagggtccctctctgtctccctttcacttcatcatgttagtggagttgtttgtcctactcagcagtttagccaagaatagtggtccccaggcaatcaatcctccctccactgtgctcccttccagggctggcacttggcctctgccagcaggccatgtgggctcagtagcttgggaagcccttctctacaggcagagccaacacagctgaagctcattttctcagaacccctatagccaaacacagtagtgttcctgaagacagtagggtttccttactatttgaatgcacttgggcaccgtagaactctctgatgactattgtccagacagaagatgacctcttcctcatagtcttcaggttgaaagagcacagggtatggctgagaccacaggctctgaccccacataactgcaccggggcccgcgagatgaggcataggccttcctgtgccctgtgaggagtcactccagaggagctctgcctgcggctggcctccaatgccactgcatttcttaaggctttgaagggacttaatgccagtctcagcatagtaaatctaaacccttcacccaaagttcatgtgttaattgcaaagatcatctgactttaaaatattgataatagaaatgacaaagacggaacttgagtaggcaacaacatgcaaggcagacaggtctttgcattcttgaaatttgatacttaagatgacaggggcaataaaagaccaggaggagaggcttgcttcaaagttggtcttatcaaaacaccttgaggtgttaatgactttcttaacagaactccaaggctataaactgctttagatccaaggatatggtgatattgaatgttttaattgtggtattaacagccccagttgtaaaagggaaggtgtcactcaaagatgagggacaaggcctgaattttataaccgaatttaattggcactgatttgacgttgatagtacctggtttttccagttttcaggaaatatttctttgcctggggggagaggggggagcacagaagggaaaggtggagggagagtacatgatgcaggaggggaggagagggtgctgcacatcaaaaggcccatcttgaatttcctgtgatgtgctaaaaccccagccccccaccaccacatcaatgcacagagcagtcacacctctcctacatcaaaccccaattactacacacccagggaaggtgcccagctctcccactgcagcagtcacccaaatgagaaggaaggaggcatacagacacccaaaggtaagaggaaaagacccaaagccagtagagcccaggaggagaaaatcctgatggggtaaaaaccttctaaggatcttcctgtctgtaatgtttttctctccccaaaagacctgtatctgggaacaactgggtcatttattatctttttttttttttttgagacgaaatctcgctctgtctcccaggttggagtgcagtggcgtgacctcggcctcccgggttcatgccattctcctgcctcagcctcccgagtagctgggactacaggcacccaccaccacgcccagctaattttgtttttgtatttttagtagagatggggtttcaccatgttagccaggatggtctcgatctcctgacctcatgatccgcctgcctcggcctcccaaagtgctgggattacagtcgtgagccaccgcgcctggcccatttgttgtcattaaaagatataatcatgacactttggacactcaaaaaataaataccagtacccttcacacacacacacagacacacacatgcttgcgtgcacacacacttttctaagtgggtggcatagttaaaaaatgtttggaggaatattaaagtaagtttttagaatgttcatgtaaaagaggcaggttgtgctattgaagagagtcttagatcattaaaaaaaatttaaatgttaagctgaactttataggatttaattagaatgaatgaactgttccttattccagacgtgctgttattaagtatgtttttgtcatgctacacagtttgtggaattatttccaaacatttggggtctgtggctctctggaaggtcttctgattaggaacctcagctctctgggtagaagcaagccaagggctgctgcctgctgtcacttagtgagcactgagtgtggcgtaacggagagtgtggattccagcactgggatgctctcctgtggacacgccttcagcacttcttctttctggaattggagtgctatttgctgctccatttgctcagagaaacctagttctttaaacagctgccctttgttgttaaaagattatcctcatttcagtcactggtgactgtggtttggttgggcttttggagtttgttggggtttttttcccccaaagtacctgatttcctcttagagtagggacttttatttctcatattttgggtttcctcttcagtttagggaaagatgaacagctccatgacctgatcccttttcgtcacagttccctgttagtgggactgctttggagccgtggcatcatgtggcagagactgagacttgaactggagtccagatgacctggcaggggcttctggctgtagcacaggtcaccggtggacctcagaaaagtcctggatctctcagagtctcagtttccccaggagtaaataaaaaacgtgccccatctatacaagcctggatgtttttaattagagcatttcaggaggtgggagggatctgaaagactatcttctgtgctgcccagtggggtagccacagccatacgtgtctgtttaaatttaaattaagtagaattcattaacatgagaaactcagtgcttcaggggcagtggccacagttcaggctcagcagccacagaggccatagtcctggacagtgccaggctcagctgcctcagctgatggttgaggaaaatggtccaagaagtgagtccaggattggcccatgctccagccagagccgaccctactggctcctcagtctatggtcatctgcttctgagtgtgtgggtgtctctccagccagctcacactttcctctttctgccttatcttcccacaagaaggcagagtctacagatggaagggtccctctttgcaggttgcaggccccaggccaggcagtcctgtgatacccatagcctgggaattgcccagaattggccgcaacattctgcagtgctctcaggttcattcttctgttgaaagggctcctggctcttgcagatcatggagttttataaaacggagtctctaaaacccctcttgtaattgtcttctgtcttgactatattgctgtccacacctgactactgtgcaggtgccatcatcctgtaattttaccagacgaaaccattggggtacattgggtaacggggacatgggatctctctgtattatctcttacaagtgcacgtgaatccactttcaaatagaaagctcaatttttttaaatgtccttgtgcagtttttacaattcgaatcttcttgaattttagaacgtcggctctaggcatcctagaaacagattttgaagggctcttgaaagcaaattgaattcttttctcatagttgctatgaacagtttaacagtgtgtagtgcgtgatcatttttgcttacgtagcccttttacgttggccacagagtttcagataagaatacatcatgtaaaacttcagatgtattttcccaaaactggaatgtgtctctgttgttggactcgtgcacacagtcaagtggttgaagctaggggtgtacagcagtttgcggcctctgcagggctggactggggacttacaagtgacagtgagtgaccttcagtgacgcagagccaccagattttgttcagttcaattgatcgctggtgcagatgtccctggcaagggtaagacaagtgcacagtgagccctcctgtccttggcatctctgtagctctctccttatcctagaacaacactgggattgtctgcagatctcttgtttgtagatctttgacaaaaccattgaagagtgaggatctttggatttgtgcttttaattcagcatcactctgctcagtctcttggacagaatggtactgcggttggttttgaaaagggtgtgtgtgcgatggtgtcatgccaggaagagttggccttggcatgggaggcccttgaattgcattcctttctctctttttttttttttttttttttttttttgagacagagtctcgctctgtcgcccaggctggagggcagtggagcgatctcggctctctgcaagctccgcctcctgggttcacgccattctcctgcctcagcctcccgagtagctgggactacaggcgcccgccaccacgcccggctaattttttttgtatttttagtagagacagggtttcactgtgttcgccaggatggtctcgatctcctgacctcatgatccaccagcctcggcctcccaaagtgctgggattacaggcgtgagccaccgcgtctggccgattgtgttcctttttcatcacttattggctatttgagctttgacaattatcccaaactctttaatcctccatttcattacctgtaagacagggacaacacaacctacctatttcataagattttcctgcgaatgaacgttggttcacatgtgtgaaaggctgtgagagcgtccgagcatctcagcgcaatctgcaatgcgccatctgccatcagggaaccctaaggaaaggctgagaggctgcctagacagggcgccacatgctaccctaccagagttcacagtctcacttggacatctttgtggatttccttctgtgatttacacagggaaaaaagtctctccaggattttatccaaactgttagattctgggagaggtgttgggagaaacagctcatgacttatcttacagctgcgcttcccctctttgatttccctgaacacagctagagtttttcttacaaatattaacttggaaaaatgagagttggcccagctatgcttgctatggactcactgcttccattcatttccagcacaggggccattagtgtgaagcaagggtctccctccccaggctcaggtcacgagagagcagcagcaggttaaaagacccaacacatgggctgatcacttctcacctcttccaggaagcctccccaggcttttccgcacccacccaaggctgagctgagcccaaggccccttgcatcagaatgaatgtgttctgaccatagagtttcagaaaagaaaacgtaacaataacaccatctgccagtgagtgcttttttaatgtaaatgtctgtttttgcagaacgtccataaccaaaagagcagttcaaccttcagcatgtaaatctgatgtaggcagcgggaaccaggagctctacctccctctgaagagggcctggctgtgagcagggcagggcagccaaggagggtggctggtcccagagaagctgtgctccaatgctggctcctccctgcctgcctccactggtggtgggtgtgccagatgcccttgagtgagtgaggggaggtcagcctagactggtgggtcctgggggcagaggcctccaggctgcagtgtgtctccccctcttaattatttaggagggaaaggactggcaactgttccctttcctgaatctggttctttaccctttcattaaaaattatggtcagtcttctttttctgtctgggcctccaaaacccagtcagggccaggcccagaggctctgcagcgggggccactctgcagggtctgctccagtgctggtcgggaggtggccgagcatttctgcatccatgcgtgctcacccaccactcatttatacgcctggcctctgacccaacagttctaccactgggactctattgtaaggaaataattagaagtctatccactgtgtcttttatgtacgttgtggcgttcattataatagtgaaaaactttgaaataaagtcgaatgtccagccttaggggatactcttggtacatccacatggtggaatactatatagccatgttcctgaagaatatttcaaatgaagaggctcattaaatcattaagcaaacaggatacaaaactcaatatacgatatgactccttatgatatatctatatatctatacatagtaaaaggaaatatatcaaaatctcaataatgtttccatatggtaggaccagcagtgatttttagttttcttctttatacttttacatgtttgaaaacttctttacaattagtagtgtttttacaatcaggaaaatatgaaaaaaaatgtaaaaacctatcagtgacagagccagcgtggtggaagttgttgtccacttttctgctggctgacggggcagcagagacaggtgtgcaccctgccctggctcctcatgcccccaccttccaaacattccagattatacttattctttgcctgatctgagaaattctggtatcctgtttttggggggagcaccacaggtgaacccatagaggcattcatcagcaagagcgtcttgagaacatagaccaccctccactaaacattctgaggcagtgagcactttttttgttcagacaatctcctaggaaagtgtcaaaccagctcctaaaaacagagttaaaaccttgggggatcctcagtttgaggctcttgtggacaaatagagaaactgcagccccggggagaactggtggttgccaggacacccaggccagactgagccagggctgggatccccaccccgctcctcttagcaccctgtactatcagtggacccagccacagggtgtgcagggtggacaggccagcacccagcttccctctttggagggcactgctttctcagagccaccgtggccacgttagtgcatcatgacattgactgagtggctgcagactagcatgttttaaatggaaagggaccatgtggtatagcactgtgtaacatggtctaggatggagaatgttgtgtagggcaagtgttggtttcacttggatatgtgtgtgcttgtatgtatgtgcgagtatttttagagaaggcttgagtttcttgagagacctgtggaaaagctggtgtctcagaagacatatctttctcattttcagccagcactcctcatcaagctcctgaatcccctgtagacatttggctctcatacgctggggaaaggcgaaatctccactgcccacggccccagcagccattcaccgggcatccagagctgagtcccagggcgcatgccacagccggcactggcctggctggagccccaagggtgtgtgaggccccagctcccctcagccccatgactgctgtgagaaccaggtcccttggaaacctgacaacctgagtcatcttggcacaggttttaagcatcacagagaaacaaagcattgaaagatgcaatattctgctcatgaaagacccaggaggacctgaactgggttggatcagggagaaccccaagtcacagcccagcgtcccctgcattacagacactggggagctctgatttctctgctgcatgtcttgctctttgggaaaacaaatctccaacaccaggtcatctctccatccaccaggctgtaagagttcccagatcgcagaccacagggcttcataggccatcatcagcccctctgcacaaacttggccttgcaatggccccatcagctttactgaagccttggctttcctcgggccacctgccaccagcatgccccatatacactccattagtcacgattctagctgttccagagtcaggaattcacgggaagccacagagaactggtgttgatacacgtttttctggctctaacccactttctaagcatgattttgggagcacagtgtcccgttcttcatgggtgccaattccaatggcctcagccactagccatggaggccacttcttgaggacttgcagggaagtggcattccatgatgtggatgtggctcccaggttctctcatgaactgtgttgtcacctgccccaaacttggtgccttttcccagccagccatgagcctggagagcccactatctctggctgacacttccaagtggctgtaacattcaacagaattcattcacatccagtcacaacattcaacaaaatcagaagccttgcgcttgagctttaggtctcctgggccagatatctaggggtgttccaacagaagtcacctgcaaaggcctgagagctggacttgggcttcttaactacagagactgactcctggctctgccattgctaagggagctagctgtcccgagcaatagggcggccatggggtgccctcccaccgtccttctgccctctctactgtgcgtcctgggtccagggtcttgccatgcccccctgttctgccccctgcctgaacaaacgcacccttgtgagccttctgcctcagctcctggaaggcactgccctggggttttttttgttttttgttttttgttttttttttcctgctgaaggaataactatttcatggttattaatgaaagtgatagcaattccctgtgtatttatcttagattatgtggtcgttacgagctgaagtacctcaagcagccagtctgcggttgatttgaaaacaggcgagtctcaacagtgagcttaaggaaaggtgtcaggtataaatcttgtcttcaaacagccagggtgcattccagacttcagagacacttctttgtataaaggccctttttttctctcccgcctttctttctcctgggcctggaggaggatgaaagtgcaggggtgtgtgcgttcgtttagtctgataatgagggtgaggctcacgggcatggtaatttggcagctttggcacttcctgtaacagttttgatttttttttaatccaaagggctgcttaaagacaaacattttttgttaaactgctggtagttcattttctgcaggaactgtgcaattaatcttgtttatattaaagagacaggttgcttttgtcagctttcctgcgctataattaataaagatcaaaaacgttacaaaaacataatatttagcttaatgcagatgaggctaggcaacagctgcatcaattagaggagcaaaaggggaaagaaataccctttgctttggaataactcggatgcattaaaaaacatggattgtgaggcttctcacctccactagcctcgcctggtaggcccggtgaaggatggggtttggacatcaaatagtttgtaaggccgcatcaattatgttgtaaatgcagttggaggcacctactcttaacccacgtttatccaggtgtgtggctgtggatcagaagcatggagcctgaggatctctgcagtggaggagggtgaagaaatcagatggcaggcagaacctgatagaaccatccagccccctggggggcctccatgagcccggggccacttgatttatagccctctatttgaaggactgtcattagaaaccaaaacagtgattagatatgcccaaacagatgtcattacctgcccccgacttcctaaaccagtgactaagacctttggcttccacatgagagttcaaacagggtcatctctgcccataaacaagaggcgttgctgtttccaggctttcatctgtctcacgaagcgaaggtgaacagccacctgggagcccaccagaaatttggtggagatgcagtgtgagggctggaactggttgtcagtggcacccaggccagttacctcacttagatttcaaggaattgaggcctggggaaagtgtagaactgcaagtcccacagttacacagcctttgccttggctgggcgtggcggctcacgcctgtaattccagcactttgggaggccgaggcaggcagatcacctgaggtcgggagtttgacaccagtctgaccaacgtggagaaaccccgtctctactaaaaatacaaaaaattagcggggcgtggtggtaggtgcctgtaatcccagctactcgggaggctgaggcaggagaaccgcttgaacctgggaggtggaggttgcggtgtgctgagatcgtgccattgcactgtagcctgggcaacaagaacaaaaactctgtctcaaaaaaaacaaaaaaaaaaagagagctttcgcctttcctgctgagcttcaaaacttgggatcctaatcgtaaaagtccaggacaaggagggatatgcaaaatgaatcataacccaaatattttcagcaaattctggtggcataagaaggtggctgagcagatggaaggaactgcccataatcaagcatctatgagggaaatttcactgtcagtcaaccatctaaccagaaaagcacccaagggagccttgtgccttgccagatttcaatgccatgtgtagtttcttggctacccagaatggactgataaacatcagaacctgctgacgtgagagactcttggtgcagtgctagtggaggacatggagggatttgagtggcatcaggaatgccagtattctaaaccaaatggagttcctacctgaaaccaaaccaaagtcatctccaagttttagaggacacctctacaggcatcataacactctcatgccctttaacttctactcttcagaatgtataaaaagggtatctccagccaggcacaaagatgttcattgcaactgtatttatgacagtgaaaattgggaaccagcctgaaggacaaatattaggggattggttgatttaattatggcttgttcatttgatgggatactttcaatccattaaaaaggctgttgttaagaataattaagacaatagggaatgaaacagtcaaaccacaagtagcccgaacagtgttttaatctaattttattttatttattttatttttttgagacagagtcttgccctgttgcccaggctggagtacagtggcaccatctcggctcactgcaagctccacctcctgggttcccgccattcttctgcctcagcctcccgagtagctgggactacaggcgcctgccaccatgcccggctaattttttgtattttttttagtacagacagtatttcgccgtgttagccaggatggtctcaatctcctgaccttgtggtctgcccgcctcggcctcccaaagtgctgggattacaggcatgagccaccgcgccctacctctaattttattttatgttattgtatttatttattttttgagacagagtctcactctgtcgcccaggctatagtgcagtggtgtgatctcggctcactgcaacctccgcctcctgggctcaagattgtcctgcttcagtctcccaggtagctgggattacaggcaagtgccaccacaccatgttggccaggcaggtctcaaacccctgacctcaggtgatctgcccaccacggcctcccagagtgctaggattacaggtgtgagccactgcacctggcctaatttcattttagaagatatatatgtctctacaaataagggactgaaagaaaatgccaaaacccaaaattaatgggttatgattttatttctttatatttttcttttattttacaattcttccataattggaaaataattatattaccttgcattcattagcacttactgttgtaaatactttatacacatcatctcatttaatttatctcattaatcctcacattctgacctaggttctattaatatcataattttactgatgagacaaccaaggcacagacatttagattacttgcccaaagttgcatagctagtaaattaagcccaaatttgaacccaggaaatcagacattagagtcctgttcttataatcactaccctttaatgctattattaaaattagttgtgagcgcttccctcagggagatgtgccagtcactcatagcctggtgggagttcctgtgtaagattatcttcccggccaggtctggtggctcacgcatgtaatcccagcactttgggaggctgaggcagacggatcacctgaggtcaggagttcaaggccagcctggccaacgtggtgaaatcccgtctcaattaaaaatacatgtatacaaaaattagccggccatggtggcgggcgcctgtaatactagctactcaggaggctgagacaggagaatcgcttgaacctgggaggtggaggttgcagtgagccgagatcacgccattgcactccagcctggtcaatagagcgagactctgtctcagaaaaaaaaaaaaagattatcttcccagtgacagctgcttgaataaaggtcactgagggaatgtgacagaggaaagcagacagagacacagaattcagggaccatacataccaggcacagggctgggtgggatgagcgttgactaagatgaaaagagcaaagcatgtggctcacaattttgccaaggagagtgggtggggagccttttccaaggatagtttcaggactggtggccacataatgggatagagaccaccacacctatccaaagtttgcagggcgagagagggcaggtaggctgcagaatgtctgtgaaattcctttaagtaatgagctattcaaataataagcatatacattaagatgggaaaatggcagcccatatatcttggggtataggtcttgatgtatagctatctgcccacacaccacaatctgctgctggtctccggaacaggatctccagttctaaagagaaaatgatctaggacataacatggaaatgccatctatgctatctaggttgccataactgcaggattttataagaaggtggtgagggaattggtggataaggtgcgttacttttcctcactgggttatctgagagaccatagcaagaaatcatagaggggataggcttatacagagagaggggctcctttaattctctttgtctgaccctagaagacttatcatgcctttcaggagcaaccaaagaagttttaggatcttggtaatctttagtgtctcacttataatatgtagaaaaacattatttcaaaggatatccatattcttgatccctctgacctgtctggttcaacttcacttgacccttgggcacacaaatggtgttaaagagcagaggaaaggctcaaagcctcagaaccattttcttctgcctaactggcctctccacctgccagttttctggtgcttctttattgtttccatcgccaccagcctaccttaggtccttgttcacatagctacctccagtgtctcatcagtcacatccatccgacaatgacagcaccaaattagtcttcctagaaaatcatctggttgtgtcctggtctaccaaaaacaactatagaactggacaagtatgggaggtaactgcaactgtcatcaggtattggacaacaaacagcacaggaccgtgagccttaagaaaagtaaaatatacccattcaccctggcttcctagccagagggaatttgtagactgtagtgaggccaagcagagaggatgtcttaatgagatgaagaggcagagtttagagataaagtatctacaatttgtggaacaggataccagagaagagagtactgcacagaagaaagtcccagaaatcagcatgaagtttaccggtgggtcttggccaagactcggcacaagctagcagacaacagagaacacctgttgtggacagcagagctcagatgcctcacagggataagcaattctgaagcatcggcttagccagaatgcagaaagctcagccaccactttgagctttcaatagagactccaagagcacagatggattatttgtaacacaaaggataaatgcttgaggggatggataccccacttttcatgatgtggttattacgcattgcatgcctatatcaaaatatctcatgtaccacataaatatgtacacctactacatacacacaaaaattaaacgttttttaaaaagacctcagaaagtctatacttcaggaatcaggataatgccttggaactaaaagcagaaacataaatagaccaaccctaataaagaaaaaagtcaagactgacaggtttgggaggatcttccagtaatttgacacttgcccagagtaaaactcagtgctatttaaagtagatttcacatatcattacgatgtctggcatatgataaaacattaccacacatacgaagaaataggaaaatgtgacccataatccaaaaataatgaattcaatagaaacagaccccaggataatccggatgttggaattaactaagactttagaataactcatattaatatgttcaaggatttaaagaaaaagttggatttaatgagtgaacagatggagaatctcagcagagcaagtgaaagtattttttaaaaaggaaatcctagaagtgaaaagtatatctgaaatgaaaaattcaccagaagggctttacaatgtattggaggctgtagaagagagaagcagtgaattaaagtcagatcaattgaaccttcctaatctgcataatagagtattttaaaaatttcatcatgtcctcattattcagaaaccctcctctcctatcttgtgtacttaaaggaaacaaaatcctgatatttaaagtattttgcaattagtcaccaaactaccttctacccaatctcccagtccccttcacatgaacccattatttaaaccaaatcaatcaacaagctgccccagcacctgtacctccccaccttggcccttccacacatggtgctcatacctgaaattctctcccctctttcaggtccttgagatgatatcaaatgccaccattttaaccttcttcaatgtgcctaactagcaatgtgatttctcccttttgaccttccgtcaaacaaacaaatgaaaaaacaaagcagtaacaagagaaaaataaaacatgcttttgcttctttgtgaaaatattcttggtcctgcctgcatggtcttttgtcttggatctaagccctcttattagactgtaagagtgtcaagggaaagtctatgtcttactcatcattgtacaccattcaatacctcaagagaccttgggaagatcataatgtctgccgaattaattggaatataactgtgatttgagaagatagtccataacacaggcattggttctgatatagtgttgccaagagctttcactgcatatcatagatctaagagaacctcgtggactcgcagaaatggaagaacctttagaatgatctagtataagaccctcattttacagttaaagaaattgcaggctttagtgaagtgtcttacccaaggccccatcctgatccagtgcccttccctgtaaaccatatcacctttatccctgtgccaatatctatacaggattgtgtataggatttggaacaataaatttaaacacacatctaaattttgacaagaataagcccctcccatcaagctgtgctttatattaaattcatttcagtttttctggagttcactacgtgctagtacaataatcacataagacatcctggcctttctggtcgaattcctgtatgaccttggacacaatgctgcccagctaacagaaataactgatggttcagttctttgtgaccatttgctaagttcagagtttcttcaatacctgtacagtagtgtggtcattggaattacatggcattggcctggtcaaatgcagaagaccgatattgagacccttcaagacacagctgctataggggaaactgagctcatataaccaggagaaggggaaagatgggtttctgaaaaaaggcttcaagctacatagaatcctctcaggatgctgagaaactcccagggcaggtagttatcagcctggtgagcaagtgcaagaaataactggattatgagaggcatgcctcacaagtggccccttcaatatagaagcatcagtgctcccagatgctggacaatggatggcagacaaaggctgcagctgagtcccccaactggcagctgcccttgggtgaagaagcctgcctcatgcaaggtcacaccccttcctgggggcctggttaatgtggatgtgtgaaggcctgggtcccttgctccagttcaggacagctctgtagggccatccctgtgctgagaatgtattgccccttctgccaacagtgttgattccaaagccttctgataaatatcttgcacttacatctccagcccaaggtctgattcccggagaactggactcatgaagggagcaagggcagggatgtggagaaggctgagggcagctccaacagagcagaggggacagcatatggctgtgtgtcacgtccagaatgcagacttggagctttgtggtgttcaggatgaagtcacacactgtccagctttcagctacatcatgtcagaatatgaacgaataaacaatctcttgtgcttccctggttgatctggccttgtctggctcatgtgctgttaaacaccatcggcccttataaacagaaatacaacatgctctacataaagacatcacatctaaattagccagaggcagtggcatgcacctgtactcccagctactcttgaggctgaggcgggaggatcattcgagcccaaaaatttgatgctgcagtgagctatgcttgactgagacccgcctgtcaaaaaaagaaaaaaaagaaagaaagaaaaagaaaaggaatggagggagggagggaggagggagggaggaaggaagggagggagggagggaggtagggagggaaggaaagagaaaaaagacatgacatcttagatggctgtcatctgttctgccttgtagggctgaacatgtccctatgtgtgctgcattcactcttcagccagcaggcccctcctggggtcataagtgcccctccccatggcaccatgcccaggccgcactcagtgaataaaccatctgacaattgatttgtccagtttgctgcacccaatctccacagttccccctactcccatatacatttgttatttcaaaaacctcaggaaatgagggcattggcctccatgagctcatagaatctttgatttggaagggacatattactcggaggttattttccagtcacatctgcttctaaggcaccatgaagacctaacccatgataaatcattggctacatacctcatcatcttaactgagtcactctttctctttggagtttgagaagaaataaggacatgcatgttccatatggcacacaggactggggttcagtggcctctctggttggatgattagttcctgcagccccaaaccaatcctccaacctcagatgattatgttttatgagcaagagggagaaatctcatcacatttttaggaaaaaaaaagattttatgatgcaattaattgcaagtcatgcactggtttggaggctgttagctaagacctgatggcagcaggaagtggatgtccccatagagttgtgggacgcagtaggcaatattattcagagccaactggaggctcaggtcaaacacagctgtttgtcagcataagatgcccaagccgtatcttcccactgactgaaaagcaaaattatcagatattgtgcatgtgaatattaatgcattgcttttctctttggaataattaatacttgtattattgcttttattaaaaatagcctatgttagccaggcttggtggctcacacctgtaatcctagcactttgggagggcaaggcaggtggaacacttgagctcaggagtacaccaccagtgtcggcaacatggggaaatcccatctctacaaaaaactacaaaaaaaattacccaggcatggtgtttcaagcctgtagatccagctactcaggaggctgaggtgagagaatcacttgagctctggaggtcgagactgcagtgaagccatgattgtaccactgcactccagcctgggtgacagagtgagactctgcctaaaaacatgtatgtgtttttaactaatttttttaagttttttagtgatgggggtctcactgtcttgtccagaccagtcttgaactcctggcctcaagtgatcatcctgcctcggcatcccaaagtgctgggattatacgcatgagccaccatgcctggccaactctactttttagtatatgatgatttgtctctgtgtccccagccaaatctcatctcaaactgtaatccccacatgtccagggagagacctggtgggaggtggttggatcatgggagcagttttccccatgttgttctcatgatattgagttagttctcaggatatttggttgtttgataagtgtctggcactccccacttcactctctctctctctcctgccaccatgtgagacgtgccttgcttcccctttgccttctgcgatgactgtgagtttcctgaggcctcccagccattcagaactgtgaatcaattaaatctcctttctttataaattacccagtctcaggtagtatctttatagcagtgtgagaacggactaatacagagaattggtactggtagattggggtactgctataaagacaacctgaaaatttggaagcaactttggaactgagtaacagacagaggttgaaatagtttggaaagctcagaagaagacaggaagacatgggaacgtttggaacttcctacagacttgttgaatgattttgaccaaaatgccaatagtgatatggacaatgaagtccaggcttaggtggtctcagatggagatgagggacttattgggaactgaagcaaaggtcactcttgctatgctttagcaaagagactggtggcattttgcccctgctctagagatccgtggaactttgaaattgagagagatgatttagggcatctggcagaagaaatttctatagcaaagcattcaagatgtgacctggctttttctgaaagcattcagtcatgtgcattcacagaaagatggtttgaaattggaacttatgtttaaaaaggaagcagagcataaaggtttggaaaatttgcaacctaactatatggtagaaaagaaaaacccattttctggggaggaattcaaactggctgcagaaatttgcataagtaacaaggagttgaatgttaatagtcaagacagtggaggaaatgtctccagggcatgtcagtgatcttcacaccagcctctcccaccacagacccggaggcctgggagggaaaaatggtttcatgggccctgtgcagccccaggacttggcatcctgcatcccagccactccagctccagctgcagctaaaaggggccaaggtacagctcaggccattgcttcagagggtgcaagtcccaagccttggcaacttccacttggtgttgggactgcgggggtgcagaagacaagaattgagctttgggagtctccacctagatttcagagtatgtatgaaaatgcctggatgtccaggcagaagtctactgcaggggtgaagccctcatggagaacctctaccaaggcaatgcagttggagcccccacacagagtccccactggggcactgcctagtggagctgtgagacgagcaccaccattttccagacccgagaatggtagatccaccgacagcttgcaccatgcacttggaaaatccacaggcactcaacaccagcccatgaaagcagttacaggagctgtaccctgcagagccacagaggcagagctgtccaaagccatgggagcccaccccttgcatcagcatgccctggatgtgagacatggagtcaaggaagattttggagctttaagatttaatgactgcccggccaggtttcagacttttgcatggggcctatggcccctttgttttggccaatttttcccatttggaatggaaactcaatggctgtatctccattgtatcttggaagtaactaacttgcttttgattttacaggcttataggcagaagggatttgccttgtctcagatgagactttggacttttgggttaatgctggagtcagtaagactttgggagactgttgggaaggcatgattggttttgaaatgtgaaaaaaaagatgagatttgggagggaccaggggcggaataaggtttggctctgtgtccccacccaaatctcatctcaaattgtaattcccatgtgtcaagggagaaacatggtgggaggtgattggatcatggggcgctttcccccatgatgttctcatgatagtgagtgagttctcatgagatctggttgtttgatatgtatctggcacttccctcttcactgtctttctcttgccactgtgtaagatgtgttttgcctcccctttgccttctgctatgactgtaagtttcctgaggcctgccagccatgtggaactgtgagtcaattaaaccttctttctttataagttacccagtctttatagcagtgtgagaatgggagaatggactaatataattccactttttagtatgtaaaatatgtgtttggccagagagccaactttttaagaattgtttggtgctgccaatattcctgacaccagtccccaaggggttgtctttgtgcataattcagctctgcaagtctttaccaagccccatggtgtgcaggcacagggcaatgctgaacacactcagatatgtgttgtcccaggtgctactcccgtcactgtcacccgtaggtactgacatgagtttggggtgtatctgaagagcctgtgataaagtcgggggaggctgagtatacccagtcatgccctggtgcattttgtacctgacagctcctcacagctgctgggacacactccgagcacatctcacagggtgtggacgactgccaggaggaggggctggtgtgtccttggagtcaccagaaacttggcagccctccctaatgtcagattccttcatgtctgaggactagtgctgccagtactagtgcagagaatggagtcagaaaatgcaatcaagtcattagtttgcttgaactgtcttttattttgaggaagggtcaaatggaagcataggatagaataggcatcttcatgacaaagtaacatgtgcccctggcaacccacattctactttccgtctctgtgaatctgactactctggggacctcatacaagtgggatcacatgatatttgtcctttcatgactggcttatcttacttagcaaaatgtcctcaaggttcatgcatactgtagcatgtgtcagaaagtctttcctttttaaggctgagtaatattccattgtgtgcatatgccatactttgtttatccatttgggatccatggcatttagaaataaatagatctcaaatttttagaaagttagctgcatttttattttcctttcatttccagtcctttttcctggtgttctttgtggctggcatttaaaatgcagacagtgccaacaagcccagcttatccatcctgttcagccctctgctggctcctcttaagacccagagacattgccccttttagtaatttaataaattagtaagtctcaaggctttaaaacaggttttaattttattttagtaccagcatactctagttccaaatgccttggcgttgcttgggggctcttggcatggggataaataaataaatggccttggaactgctggagtagtgaaatgtgtaatgaaacacctaataaaagatgtctttaaagattacatgcttggactcagtggcatagcatcccattggcccctggaatatacagtgccccaggacggggagctcgcccccacccaagctgggcttggctgagtgccctatagctgttgctccccacacaggatcgagcttcctgagctgcctcacggacaggcagcgcccacatacatagtcacaactcctttgcgcattcaagggcagaaagcaccagactgtacaatgcaagccagacagcagggggcaactttttcaaatcaccaggctggtataatacggtgatcactgaaaccttgccctttgcaccacgggaaacatccaagcagggacaccctaggccttctgctcatgtcaaagggctcaaagcacctccccggcgtcagttcctctgggacctgcaggtggcggcgaccatagctcctggcctgggattagaagcttggcctctgcggtcagctctctggctcagccttctcccttgactctgtgacctcaggaaggtctgggaccggctctgtgccacagctccctcctctgcacggtgggggtgctgcagcccctccctcccaggcccagacaccaggacccagggcctctccttgttttgctgcctttgcccaccctatcccccaccctggcacttagcccagcagggcttcgtaaggtctgctgagggcaggaatgtgggccaggtctgcttgtgaaggagcccattatcaatccaggagagcctgcttcacccacagccagattaacagccccatgaggttagaggcaacagcattggctccatggccattgttgccgcagccatagtcaaactattttaaattatctgaaagaatataccattcctgggccgggcacggtggttcacgcctgtaatcccagcactttgggaggccaaggcgggtggattacctgaggtcaggagttcaggaccagccccgccaacatggtgaaaccccgtctctactaaaaatacaaaaatttgccaggcatgttggtacagccctgtaatcccagctacttgggagactgaggcaggagaattgcctgagcccaggaggcagaggttgcagtgagccgagatcgtgccactgcactccagcctggctgacagagcgagactctgtctcaaaaaaaagaatataccattcctgccgaacagagacagaaacaggaacagagtgtttgctcctacgtggctggatagcaattgcctgtgtacattcctgagaaaccacaatctacatcaagccttttacattcaaaacacttccacatgcattcacctcagtttaccctctgagaaatgagtgagcaggaaaacctgtctccctgttttggaagcaacgtaactgaggtgcagtgggtggaaatggtatgcaaggttataggctcagaggaattctagtctctgctcagccccgggctggcatccagccctctgccccagcctgaggtgtgctgcggagcaacacagagcatcctggagaaaggaggggtgctcagccccatggattcatctcccccaaactggagagcagacaccagccaccaagaaagagccaagaaaggatggctgctgttactcaacacaccaggccacggaaaatacgcggagtcttcgctctggacattctgttgtgctcggaagtgagtcctcccaagcccgtggtgactgccccatgtcacactggttctggataattcggactagtcaccacctgccccagcaatctctttttcaaaaagtttgtccagggcttcggtagtaacatcagctctttcaccttggaaaaaaggcacagggtagagagatgaatacggtgtgattgcagtttaatctgtatcccattcatacataatttaactatataaagaatgaggtgagccagaaatgaaaggttttactctgatccccaagctctgagggatagaaagcctcccctctgtttctcccagggtgcagcagagccctttggagtcggagcagacccgtctcaggtgctctagctaggtacctctgctgagcttgcccttctcaaggccttcccgttactgtacttgaaaagagaatgacgaagaaacgaattctctttcaaaccggtagaacaagaccctgagtttgacaggaaggatccaaatttatgagttctttgcttcatgctgggactcgaatgtaagggagggaaaaaaagcccactctgaaagggacatgtaatggttatttatagccctgcaccatgcgggtcacctgcccggtgaaacgccatctgtgccgggttacctgcacgtcagcgaaggggccgggaaggcatggtctaatcccaggattaggagcagggagaaaatccatctattgaatcgttcaaaacaaacaaacaaacaaaaatcctacccgctcaaacttaaaagactgggagcctgaaaatgtttttgttgctgctgttgagttttcttagcgcgcctcctcctgaagttctcagggcacgaaccttcgtgagagtccagatggccagggtggtgcctgggagcgaagctggcttcgtggtaaaaggagaggcgggaacaggaacgcgctggaaccgcagggctcccgccgtcttgaaaggcctctggcgtggaaagcaggtggcggaaccgcccgcctcacggcctcactcagcgcagactcacaaaatgaaggcaccatttatgtcttctagaacgggagggagacggggacgctggcccctgccgtcgccgtggttcatcgtggttcacctggcctccccgggaacttgccaactgccacaggtccacaggggtgggatgaaaccaagtccatgcatccacgcccaggccccttgactcgcttggagcccttcctcccctcagccccagccatcgccagcctttctcttggctcccagacctctgttcccaaagctgtgtagaagtgtcgaaagttgagtagatccggcattgtgcctcggctctcccacctctgtctgtgtgaccttagcaagtcgctcaccctctctgagccgccattgactccatgtgttatgtggggagtagtgagtgcctcccttgcaatgctggggaggtttagtgacacgtctggcgctggataggcccttcacgaatatgctcagcaggctgagagatggggcctctgcccccagcacacacacctgcaggtccacttccaaacacaggttccggaagaagcccagcgaactttctctgaggcacctgtggagtttccatcacacaaggggcacctgaaaggcagccaccttccccagccagcagggaaccgtggcatggacaggcctctctgtgcagcagagctttgtcagctgtgacctgataagctcccacctgctgtcgggcactggcctccttgggcatacacgttcactgaggctgggaagaggctgctgggaccagggcagaagtgcccttgcgtagtgagggcctcacacatgggctgtttgcttctcctctgagccaattctgtgtgcgagcataatacacatcctaggagagaaggcttgggttgagggtgattatttataatggcagtcaggttgttgtaagacaccatcttttggaagtgacttgttgagaactagtccctgggtgcctctgggccaaggagatcgtttttcttctccttctactcttccctgttggccatgcccccagctggtgcagaggaccctcagagctgagtgtaagttacccatggcagctgccagctggtcaggaagggtcgccaggaagcccctcaaagggaacagctcaggggaagctgtttggaagctcagtgcctccgccttgccctggtgactgggaggaaggctgtgagctaccaggactctcctctggccagagcagattcagacaaaagccaggggcagcccctttgggaacctgcctcacgtttgagtcaccgacatcaaaagcaaggtcaggactgcccaggcccagaaaacaaccaaaaaccattttgcaaatgtagtcttagcaaaaacaaatggaatgggcaaatggagaaacattgtggtttacgaatgcagtggaatacgattcggcaataaaaaggactaaagtcctaattcccacaacgcagacgcatcacaggtattatattcagtgaaagaaaccagctgcccgattccatgtatatgaagatctagaacaggcaaaatcggtttaaatttatagtgatgaccggtgacagcccagcgtggggcagattgatgatcaagggcgcaagagatgctctggaagagatgggctctgtatcaagccacagggggtgtatatacgttatcaaagtctcccacctgtaactggaaaatgtgaagcttattgcaagttaattacaactcaataaacgtgattagttttaaaactatcatctgagcaataagaatacaaaaatctgtgccactaatcaggacatcaacttgtaggttcttggggaacatgcagagtctgagaacaccactctcatcattttgcactgttgcccctggaagcctgccccgttcagacccacgtcatcgcgtggtgtgacgtgttgtaattgcgcttggtctttgctcagaagctgcttctttgttattctacacgtgactccacattcacattgtgtgacgacggcactggatgcttgatacagaggaggagcagagagcctggctgctctcacctccgcccgatctggggctcaggcatggcccaggggagcccagagtacatgggccacgcactgagattcccactactccctgggctcatagtggcttcaaaggggcagctgaggtggggagtgggaggcaagggctgcagagtaggaggcacgtgggccggctcggccatggaggagccacacgtgctttgccagcccccatacgtcctccctccctgcaccttccccttcagaccatccgagccatcctgggaggctcagcctccaccacccatgtgggcaccttctgcattacctacaatagccagcctgagaggagcagcaagccctctgcaggccctcgggacacgtaataatggcagtcatctttaccgcctcttcacgtcattgcctgcggcagctctgtgctattttagactctattgatcctggtgccaataaatggttcatattcttcaacttccttaacttagaggctatcgtctcagtcaaattgatgtcttctgtctggctgacatagcttgggattctagtagcgtgtctttcaatgattaaggattacgttcttgttttgcttttgttgtgaagcagaatcagcgtcactgagacacgttcatgcaggaggcctcgtctccatcacaccacaaatactttaaggtgccaactttctgttctctagtggagtccagatccaacaggaatggctgggtctgggggaggcagggcaggctgaaagtattgctttccaaatatctctgagctgatgagagcaaagaaatgaggacaagagctgagggaggacccagcacagtagcccattggcagaaaacaagaaagagttcttggttttatcagaatgcagttaagcaaataactcattcatctattgctgagagaagagggtatagcaatggccttacaggggatacactgtgactgcacttcctaacgggacatgttctcctcctcccagccctcacccacactgttccctctctctctacttttccattgtgattcctggctaactcttagccatcatctcttcttgggacttgggacagtcctcctgacctccccacctggtaatctgtcattagcacccattttcacatacgcatactctgcactagacacttgaagtcaggagttcaagaccagccttgccaacatggtgaaaccccatctctactacaaatacaaaaattagccaagtgtggtggcgcacgcctgtagtcccagctactacggaggctgaggcaggagaatcactggaacctgggaggcggaggttgcggaggttgcagtgagctgagatcgtgccactacactgtagcctgggtgacagagcaagactccatctcaaaaacaacaacaacaaatggaaggatgagtggcatgtgtattaaagtgctgaagagtggctcctatcatgtttcaacaaaacttcatgttactatgcttatataagagtcctagagtggccaggcacggtggctcatgcctgtaatcccagcactttgggaggctgaggtgggcagatcatgaggtcaggagttcgagaccagcctgaccaacatggtgaaaccccgtctctaataaaaatacaaaaattagttggatgtggtggcgggtgcctgtagtcgcagctactcgagaggctgaggcaggagaattgcttgaacccaggaggtggaggttgcagtgagccaagatcatgccactgccagcctgggctacagagcaagactctggggggtggggcggggggggaagaagtcctagaaaaacttgcattttgtaatttaaagcaatgtgttagttatgataacttttctgatttcaccctgaaaatgctttccctcaattttgataaggcaaaaaagtagggattttttttttcaaaacttctccaagcttgtcagttcgacaagatcctttcagctctgaggcattcaatgaaacagaaatgaaattgtgaacacatatctttacagcaggacattgggatgaggataagtgctctccctctgaacttctgcatggatatttgcaagccacgttattttcgtgagcaatcctccaagagtgcagagcacccgagcaccacaaactgcgggaaatgcagagagagcttccttcctctttgggacgccagccccagttctgtgtacaagtgcacacacacctgcttcataacataattagcattctgagaagcccaaacctagtctgacaagcagcaataaccatgttggtgttcagaaatgtttttaggccacgactgtttactgcacttcagaaattatcatcgtcactggtttatatgtaggaaaataaagactagcggaaaaagttgagtcaaatagaaagatgagatgtgaacagatgtgtccaaaatactgattttccatgctcttcctgcctctgtgggttctgctgaagattcagtgatgcacagagagttctgaagaattggacatgcttatttgtattagtagtgatccttcaaaagaaaatctagaagtaaataagtgtttcatgcattatatttattattctacgtgtgcaagaatatctgttttctgagtattatctcaattcaaattaacaaaggaaacttgggaacttggattttaaactttcaactcaaacctacctctgtccacgtcttttgggaaggccccacccgagggctcagggccatttggtttgccctcatctgtgcctctccccgcaggtccactgtgcatggggcctgtctgggtttgccacatacacacacatacattcacacacatacattcatatgcatacactcatacacagatacacacacacatacacacacatacactcacacacatacacatcacatacacttatactcacacatataaacatacacatatacacacacaaacataaacatacagacactcacacacatatacacacactcatatacaaatacacttacacataagcatacacacacacataacattcacacactcacacacatacactcacctacacttacacatgcatacattcatacacatacacatactcttatgcacacactcacatatacacatgcatacacacatcctcacatatacaatacatacactcacacataggtgctcacagatacacatacactcacgtgtatgcacacactcacacccatatgtttggggtgggcaacacccttgagacacttagggcctgagagaatgcagggacacagcccacccctttgaggggctgccaaaggtcagtttgcccctcatagccctgaaatcttcaccagggagtttgcaaatgaaagattttcagtgcagtgataaagaagagtggctgcttataaacccccatgtgatgctgtttgaaactctggggcccgccagtgtgctctgttgccagtcacttctgtttcagcgtcaccctccactccagccttgggaaggacggtgcctgtggtcttgccaagacgtttggcctgtgctctgcgtgtctgttccccggcacagcactgtggggggcctcccctgcctggccagagaggctgggaacaggaccggctatttaatttgtgggacccagtgcaaaatggaaatgggtcagaaatcactgaggacttcaggctggcaaggccagcaggacactaagtgctgcatggggcaggagggactcccaggctaccttctctgctttcctcctgctccggtgaaacagatccgactaaagcagaagtggaaagagaatgcatccctctcctcccaatctaatattaattagcactactcagctgagacagggaagattcagagctgtaaatcacatcaaatggaagtgttttcagctgctctgatggtgaccttgcgggctccctacagggaagggaggtctgtctgggttgatgggaagtgggggcttcagggaggcgggggagtactgaatcctgctgggtgtggggaggaggccaccagcagcctccccttgggtcttcctggaggaaggagagcgtgggaggccggggaaggagagtagcgctgggtgggcagggagcccgcagccagctctgtggctgcctcccagacacaggcagttgccagcaccttgcctcccgccatggaagagcttgtgcccatggagctgagtgggccagccacagcctctcccctccctgtccgtgatgcggtcaacccaggcgtggcaagccctgctgggccaggccaggtaagcacgctggaggggccacagacaaaagggacatccgtcctacagactttaaaaggtaactccgaaccatcaggcctgccaaggcttcccacagccacctggcctcagctgcttcccacagatatgaggtgtggccctttcagggagaagcttttggaagaggtagcaccgtcacagtcaaggggggcccaactgggtggaagaatgggaagtcccggaggctggaccatctgccagccgaggcagtgactctgcttctcctaaaggtggtgaccagtagggaggacggccaccttcttcctgcagtgggcactgtctgtgctctggaggcagccgtgatgacaagtatagacagtcaaagccacaccaccaagggtgaaggccattccaagaggcgagcagctcagagaggagactgagtctaggggaggacggctaggaaagggggccaaacttgtatataatgatgtcttccatgtctggctccctggacagataaaggcccaatagagcagggaccctatctgtctggcaccgtccttagggcctataagattgccacatagtagcagctccacagctctttgttgaataaatgaatgaactctaacaagattaagggaatcggtgtctagtgcagagtctgcgtgtgtgtgtgtgtgaaaaggggtgctaatgacggcatttgttctttggaagaaggccagaacttaaagagggagagacccagccaaggctttcttcctgggctcccagaaggaattaaacattaattaaacattaaacattctctccccacctcagcaagatgttgctaggagatcgtctagaccagtgcttctcaaactttaatgtgcacacagaccacctgcagatctggttgaaaagcagatcccagacagcaggtctgggcggggctgagattctgcatttctaatgagctcccagctgatgctaatgctgctggtccaggggccccactttgagcaacaaagtggcaatggtgaggattaagccatggtagtgcctggctggggtctgagctcagtagtcataagctgatgtgattacagctgtgtcatcattctagatgggaattgaggaaggaagggccaaaggcagaggaagagagagcaggtcggggaagagaagctgttaattcaggcaggagtggcagaccttttccgtaaagcgccagatttgagatattctagacttacctggtcatgcggtctcttatatcatgaaatgcctacaggcactaggtaaccaacaggtgacgcttgactccaaaagagtgtgttcacagaacctgctgggtggcgactggcttcacaacccctgaactggatcactagccaattaactggttagttccacaagttaagcagcagccttgtctgcctcaggtgggaagagacatttccacgctgctttggtttgaatgttttccccacagtttatgtgttaaaaacttaatcccttaatccccagtgaacaggtttgaaaggtggggaggtgatgaggtcgtgaggctctgccctcatgaatgacttaatgtcatcatcgcgggagtgggttcgttatctcgagagtgggctggttataacagtgaattggccctgcttgcactctcttatcaccatgtgatgccctctgccatattatgacatggaaagaaggctctcaccggatgcagccagtcgctcttggacttcccagaaccagaaccccaaataaacttcagttcattagccagtccgtggtattctgttctagcagcacaaagcagactaagacaggtgctccctctccccatcactgtcacaaatatgggagctcagtgtgcacgaggctggagccccacgtcagtcaggtccttggtctcataccccagcagcatcgccaggcactgatggagattggggatccccaaagtaaaacaaacaggagatcacgactgggagccgtcagccccccagcgcccagtggcccacctcctgcctgtatctgcagtctgagaagtgggatccaaaccacaggctgccctgtgctcccctcccccagaccccactcaccctctcagagaattggtaacaataatgaaacacatctaaggccacagacttttagttctgctttgtgtatctatttttcttttctctctgcttgggtttacctgggaacgttttaattgcgcctttcgataagtgctcctggttgacactaaggtgcggcaggcccagcccttctcagttattcagggaagccctccgaggctcagctataattagaagtcaattaaattagaaaccattcatatggttcttggaaggcctccagccctgctgagagcctctggccctatccacagactcagtggaaacctatctctgctaaccccaccatcctgaagccaagtccagggctgctgggagggggaacaggctcctatcagttccccttcaggcctttgcttgcacccaaccctcccccacctgacgggctgcaggtcgcccttgcctccccgccaccccgatctcccgtcgctgcctgccccagcttgctctgttgctagaaggaaaacacccagcgagttcaccactggggtggctggctcctcaatcttgcctcagtccatttagtgttttccaaacggtaaatgcaacactaaagtgcaggcagtgtgtgggaaaaggcagtttttgaacctcatcaagagggtctggaaacagaactcttccttccccaaagccacctggaggtctccaccaagtgagacacctccaaggtgactgggccaacagccgagacccaaggaaagacccaggaccactgctgtgctttgccagtgaccccagtcaggtctgtcctctgggatctcccctgggacccccttctcccacctattcttagagcagccagggacacacgctttttcctttatcacagaattcatactctctcttctagaccactcagacaatacagacctgcataaaataaaaagtgaatgttccccagaatgctccctcagtccttggtcacccccacccgatttcagttactgccaaaaaaatctttgctggaagttcagcaggcatcgctccagacctgctttcatgcatttagaaactttacaaatacacccggaggcattcttctctatcatttctttctcacccaacaacaggtgttacagccctgcttggtgttccaggaaactgaagttcctttggattttttgtgggtgtttatttgttgcaatgataaacaagcgtaccatcttaaggccctgccaggattctgcccaccctcttcctacgggagcgagggcatgtgctgttgtactcgggaggcaggacaggcgtgctccccagggatctctggaaggcctgcagactggaagctccctagcagccagttaactgattagttccacaagttaagcagcagccttgtctgcctcggatgggaagagacatttccatgctgctatggtttgaatgttttccccacggtttatgtgttaaaaacacatatgtacttggcattgggtgcatctcctaaaggaccattctctttccagaaatctcagtgaagaagcccttaagtcctgggggatttggaaaagaagattgtccatgtcagtccccactgacagggcccttggtcttttgctcttctccaccgttccctggctgctgacttacacagctctcacctccttctccaacttaattcttaatttctttcttttttttttttttttttttttttgagacagagtctcactctgtcgcccaggctggagtgcagtggcacaatctcggctcactgcaagctccgcctcccgggttcatgccattctcctgcctcagcctcccgagtagctgggactacaggtgcccaccaccatgcccgggtaatttttttgtatttttagtagagacgaggtttcaccttgttagccaggatggtctggatctcctgacctcgtgatccgcccgtctcagcctcccaaagtgctgggattacaggtgtgagccaccgcgctcagcctctccaacttaatttatttccaataatctttcgctaatttctacctaatgcctttaggctgttgcaggacttttccaaaagaaagaaagaaaaggaggaagggagggaaggttcctgtgcatcatggcatatgttcgtcacggtgtttttgtgtgtggtattgggaattagttggttttcatgaccaatggtagcttgctaaggacgagagaattctgagggtgaaaggtcttagggagtttgggttccatggcccagctggtcttctgggctgtgtcagtggttgattctggaaggttcctcacacaacccagcatctagaagagtacttgctgttttgttgtggcaagaggacagtgaaccagagtgcagccactggggaatttaggcgatcactagagcacattatctctctttgtagagccaggctaattaatacccagactaccaagtaaaattgctttgagtcagaaacacaggtctccattcagaaagtgaaaaaacaagcaaaaaaaaagaaaaaaaaacccacctcctccttcaagggaatgcattcgtgtaatattaatagttggtgaaaagtatctgaacacctgaacagctgcagccatgctcaatcccttcaatcccttaagtagctgtgtgacctggggcaaatcacttaacctctctgggctcccactatctcaactgtaaagttaggttattggacttgtccactttgatggacaacctgttcttaacagagagagggaagaacactaagctggggctgggagagcatccagaggggcaaagaccagaatctaattcctggcagtctctccaggggtcctcctaagtcctggagcccagaggccaggactggcctggaggactccagacttaaagctcatgtaaggctaggtttctccaaaccctctgagcacgagaaacacaatcactaacctcgggtttaaccttgggccctccgtgtgctcctagcctcctctcaggctccctcccaggcatggctgcgaggctgggaaggccccagagtcagcccaagtggcatgggtacagcttcagcttcatgtctgcttttcttttaggatgtatagtttcccctctgtttgctggaaggcaccttatatccagtggggttaaataaaggtagccagacccccggctggggtgctaccgccagtgcccagctaatgacgcatgtctttcaggtgagcccttgggagaggatggcccatgtgggggactgcacgcagacgccctggctccccgtcctggtggtaagtggtctgagccccttacccccacagcaccctcatcctcatgatggttggactgtttcttggcctcttcagctgtaaaatgggaatgctgatcatagtccctcctccacagggttcttctgagggtgaaatgaaaccaggcctgcaaagcacagaactctgccccaggctgaagttacattgatttcgttggtagctcccttcatagggtctcatggatataaacgttcttgattgcttgtttgtggtgtgatacacacagccctgtgtctatgtgatgagctcatgcttgggggccgcgcagctaagaaagacttggaagactcagacccctacccccatcctcctggacacgccggtgttctgagaagccactgtattagaggctcagtgggggacaggggcgcctcctccatgaccttggcaagtgcgttgatgaggagaactcagagcaggccttgatggtgggatggggcttggccagcaggggtgaggcagggtggttctagtgggggctggccgtgcccaggtgatcaaccaggagccactggagacttagcagcagtgagcactcacaagcgggcaccttcccagaccgagcccccagcagagcccccaccgcagggcacccccttcctatgtcaaccttggggtcttgcaggagtcacatgtgtttctaaggaggtacggaggccacaacacccccctttgttggcaggtgtctctgatgtgctcagcccgagcggaatactcaaactgcggtgagaacgagtactacaaccagactacggggctgtgccaggagtgccccccgtgtgggccgggagaggagccctacctggtaaggacccagccctcctggagcctggtgcgctctcaggggaggcctcctgcttgtggcattgttgccctgagcctgccttgctgtgtgaggggatgccagggtatatcaaaccagccggtcacgctccctggacgttgagattgatggcaagagctgccgtgagcccaggaatggcactcaccagctaagcattcataaacagatttttcaggagttctgaaatgtttttaaaggatcactttcccactctaccctgattaaatgagcgtcagatcatctgattggaagcaggattgaaatattctccagtactagtacattttttcctgagtgctgcatctccctccgcctctgggcaagctaagcctgagtgttctgttcagcactaagggaaacctccggggtttcagtgtccggttcttgtagcaagctgaggaaagtcagatgccaagtgctacctgcactgcctgggcattccagcagctcgctgaattcatctcggggaggctcagaaaaggggcagcatctggagcctgagagtggcgaggagaggggcaagcccagagcatgagctggttcctggggggttttgcagttaggacaactcaggaaaccaaggcccggcaagagtagcttctggagacagctggcacgtcactgcccaaggactgtgggccgagtccgtatggtttggctgctgcactcacctgtgtcccctgtcctctttccctggacagtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctgggtaagcacaggccctcctggcaaaccctggcatgctttctgcagaaaaccccgaggggctacgggcaaggaccttgggaacaggggtcatggatactgcaggcctcggtgcagccgcacacctggccttggtcccatcccacaaggagcagcatccaggacggagagtcctggcccctccggtggacaggcagcccatcaggctctgcctctgtgtctcctaagtggccattaaccatcataatatcttctgaccaccaaaaggaaacaaattgcttgaatacttacagtgcagtagcgcatgtgaaacactttgggaaaaagaaaactaaaatttcatgcaaaagcagcatttttagtatcctgggaacactctggggaagctactaataaaaatatttgagtcatatgatacctataatccctccaaaatgattatgcatcagaagtcttcaaaaagctgaaaatgcaattagcctgaaagagagaaagataaaatcttcctttttccaggcatgacacctcagcaaattctgccagggaccaggaaaatacagactctcaatccccagaaaatcctgagccatgatcattgctgcttcctccccctagtggccacaacacatcatgctttgcaagggctacaaatagagactaaagataaaagcagtggtggtgtccctggtacagctggtacaggtgggagaggtgatggcagtgatgaggctggtggggacaagggaggtgatggcagtgatgaggccagtggggacgggggaggtgaccacagcttagtgcataaggcacactcagagtgtcctaggagttgcagaaggacctctcacctcatggctggggaggtagtgtcagcagaggtcttgggagatttgtggaggtgatgcctggatgagttaggctaagaagtaggactaggacagaggcctgcaagtggagatgccgacgccagagttcagagggctgagcagctgggcagtgcctggggctctgattgggtccctgtggccagagcaagagttgtacacctgggggtgtggacaagctgggcaggagggcagggagcagatggaaccaggctctggaaaccaccgctgaagacttgagccttccgctcgaagctgatgcaggtcaacacgcagactgctgagccagggatgctgtgggcagggagagggctggagcagaggcaccgggggtggaggagaggaagaatctgagagccccctgaaagacagcactgaccaggggtgcagatggcactcagaaggggaaagagattcagaagaggatactcaggtgtctccatgactggccatgtggaaatagtgccatttgtcagctgcagaagacaggagcaagagggtgcttggtggggaggtggagggaggatagaggttgtgtgtgtggaatttgaggggactatgggacatccagacctagatagctaacccagagatggcctgaacctccaggcagagatccagagctgggaagtcactatgcactcagggtgctgggggccgctgtagtagaagggttccccatggggcaaattcctactgcagggagagggtgggtgcaccacggaacctcgccgacctatgctgctggctctggcctggctacggttcagacctgagaaggtgtccatcagtacccgaaggccagggctgactctatggcctgaagaccacgtgcttggttctgatacatttaccagaaagtgtgtaattactaaagaagttggacactggaagggtggtgagctccctgcctctagaagaattcaggcgaatgtggacagccatctgcagaattagtgggcaggctgctctctgggcttttaaacattctttccagtgctggaatcttgatgcctcccgccctactccatgggacagtgacctgctcagtccacaccactctcagcacccaggacatagcaaggcccagcacacctgctgggcaggcaagggaccctgtgcagagacaccctcagcacgtgcctcagagtgccttcgcactgctccgcaggggtgcagacgatggggacagtttccaggttggctccatgatgtgctgtgtctgctcaaagcctcactgccagtcccaacgcccaccaaaattgaaggcccccgcctcacctccgaatcccagcccctctcaggggctcatgctgccccctctactgcagacaaggcttccccagggtaggaccctggaggccccacttcctcttacgaggctgtcacgctgtgtcacagaggaggatcacaggagtcttggcaggccggtgtgactagctccatgaaaggctgcgttcattcctgaatccaagtggctgtcaggctgtggatgcggattgccttgtcccagtctctcctgggcccaggcccctgcctgcggtttggcaggtgcttctcctgatgctccgccctccccacagtgtggccaggacacttgctgaacaatgagcagcacccgaggctttcctgttgggagaggttgtgtgggaggacctgggaaccaaaacaggaggaaagggggagagagaggttacgcttcctcacctctccaggcctcaccccggaggagctccaccaccccgcgattctggatggcgggggcagggggcaggacacagcgactctgcactggttctgcacaccaacacggttggaggaaaatgaacatctgggaatctgcggcgtcccttacaggcatgagagtcctgaagaaaggaactctctgggaaaatgtacacctattgactgagagaaagtcagtccttaaacaacagatcccaggggacccatttaaactgactcttgtcctgggctatacacctgaatcaacctatgtagaacaggggttggggggctagggagaaagtcaaatatggatcaaaaagtagcaaattagacctttccagaaagacgaagggaccggacactctgtagctgggccagagatccctaaatgaacacctgatttcgggttggtgacaagcccaggcagaaaaagacagccacatgttctttgttgctgtgcagcccaggatgagagacccaggtgtaagccaggcggtgaggagtttagcctagtcctacagagagaacctaacatttagaaatgttgcatgcagcaatacgtgctagaaaacggtggcttctccttgtcaggaggcactgaacactcactgggtgaggaaggacagtttcataacagcctcttggagccaatgtttttttaaaagtttatcaccggtcaggctcggtggttcacgcctgtaatcccaatactttgggatgccaaggcaggtggatcacttgaggtcagaagtttgagaccagcctggccaacaggtgaaaccccatctctattaaaatataaaaattagccaggcgtcgtggtgcatgcctgtaatcccagctacttgggaggctgaggcaggagaattgtttgcacctgggaggcggaagttgcggtgagccaagattgcttctctgtactccagcatgggcaacagaaggagactgtttcagggggaaaaaaaaaagtgtatcacctttcaatattccttaactgagtgacttgataggttgcatagcttgacccatacacatgacccccacagatgagggtggccagcctgtgacagaaggtgcctcgtgcccaggacaagtcaaagacacagtcgtgggacagagccaccaccctccccatgctcaaaatgtagtggccccattgggcacccatcataaagccgggtgttgtgcatccgccgtgtagccttggagctttacccatgacagagaccaagcccggcacctggggtgtgaactaggatgggcagagaggccttttggggcctctgtccacctcagcatcaaagttccacggagaagaacttggtgtcattcattcattcagccaatgtttacagacaatcatccttccttagtacctagcacaaggtccaaggaatagagacgtgaacaaggcttgccctggagggcctcccagcccaggagcgggaccaatagacgtgaacaaggcttgccctggagggcctcccagcccaggagcgggaccaatccccctaggtgggagagagaatgcgtggaggtagagtgagaaaaggtggaggaggcaagggcgaggaagtgaggcacagaggaggtgagatggggagcaggtggccacctaggagcctgagatgtttctcagaagtgtcagcgtgggccagggacgttagaaagctgcaggttgacctggtctggcccacatgcccgtgaactcacaaggccacgtggcagacacctgccttggcctgcctcatagaaagaagtggcttctggagggcagaaggtagatttgcgagaggcttagctgtaaaactggctgtcgtggcttctctgggaggtgttttgagattggttaattaatgtttacaagatacacagggatctgaggataaagggctttgagggagggcaggcaattatggtcctaacattactggtaacagtccaggctcaggaaggcaggagcccacagacccccgtgccaggctgctgcttagcactaccgtcagcaggggcctccatggggcctggctaataaaaaagagattagaaagcagccatggaaatattccttctcatcccagttcttgaatcgcaatagggaaagtgttggcaccgctcacgttatttaatcgactactcacagtgtgacaaatggctccatgctctccgctgagcatttgtttatggaaaatgggcccaggctaggataggagctagagcctgcagagggaaggcgcccgagctgggagccccaaggagagggtggtgccagcaggggctgtgcctgggagcgggacggctgcagggagcacagccacagggcagacccctgagagcaggacctgagcagtcatatagccacggggctggcactgtgacatcggggagctgaaagacataatggaacatcactgggagctgaaggacttcaaacagagctactgtgaatgatttgtcccttgcactgtgtgtgcagccccagcgtaaaggcttgcacttccaagggtgtcttctgtcaagtgctttctgagaaggaggcacttacaacctggttgtgttgccagctatcatgagggccacctgcattgacctctctggacagcacaaccgtctgtctcctgcagctgcactctggtggcattcagcagcagtaaagatggcttgggagttccaagggtcccagaggcacactgatgcctataatcccactaggctgcaggctctggggagggtgctcacagagggcatgttcctcctccaggaaggtctggccttggttggtgtgacccctggggggctaagcaggccctacatgtgggggcacagggatatttctggtggatgatgtgatggcacacacactaaacacagccaccagagagaggaaccagaaaggggctgagatcaaaagaaaggcccacgttggcagctcaatattgttaaaagaatgctccatttcaagacaggctgaaaccccaaggaaactgagtggacagagcaggtgactgagtgggcgtggcctcatgcccgacttgattgtgggcctgcagactggccaccgtgctctctgcaccagtccctgcctgtgtgctgtccagctcacctgtctctgttttgtcttgtctctcccccgtagctactacatgctggagaacagaccgaggaacatctatggcatggtctgctactcctgcctcctggcaccccccaacaccaaggaatgtgagtgtctttgtccttccaccagcacggtatttgttcagcacggatccctttcactacagagggtgtaggaaagagccggtcctggcacctggacaaggtgaatcacagtaacagcactagtgaaagtgctcctgtggcctgtccaggcaggtctatgaagggagggatgtttgccacatctgagccttgagtcagaggctgaggttctagtgcaggttggccaccagctacctgacaagtcacttaacctccatgagcctcggttttctcatcggtaatatgggggtactaacatctgaccttcccatctctcacggtcattgtgaaaacaaaggagatcacagaggcaaagtactactattttgcaaagtactacaaagtgctaggtgacagtgaggccaaggaaaatataaatgtgatcacaattaatgaaacagattccacaaagcacatgtaaacagtctcaggagtttataatcctgccttggggtgtttctttcctgttatcctttctggctttcatgggcatctgtttatgacgaagggccaggtacctctgcctcagaggaatgtgctgtgtagactcttagatgtgtggtctggggagagacggaggcaggtaggacaagcagctgggaggaagctgggtgtctggtgccgggctgcaggagcacttgccaccctctggctccttcaagggtggaggaggagctgaccctgggaccctgcctctctttgctctccataaggcgccactacccccatgtctcataataatgttgtccaggagaagaaggagagcctgcgtcttatcacgctggaaagaaggggaggagcaggaatggggcgcagcatctcctctctccttttggtcaagccaggaggagggttctgtgctgtgggctgtgctgcaggaggagcaatgcatgagccctgcaccaatgtgtttgctcgtcttcaaagccattttcctggccagccatatgctaattaattcacaaattagaggaggccgcagctcggctgccagcctgactcatggtgaagccagctgccatggcccgcatgtcctctgtggggatctaggctgattcaaggccagatcattctgggttgaagaaccagtctggaaagatgtcagacactccccacctattcacaaaagcatctttgcctgtggaacctgggagaggagcagtcctcctcaggggcttttctgttcaagagttctcacatggcacagccttcaatgttcaatgtctggcagccagagcagacttgagtcacggcaggggcgcctctctaagtccagcaatgaggtctatcacatgtggaaagcaagcaaagtcccctgagtcctcaagattttaaagatgagcgcaccccactcccacccccagcccttgcctgctttactgaaagccggctccgaggaaagcctcggggtagggccttagaatccggccctgaaggaggtcagcagagaaatagacagtcctgctgtgttcccattagaggccccttgggcaaggccccagacctcggcttgcccatctgggaaatggggagatgcggccagataggccttggggtggatggagccctctgggttagggcctcggtgtgaatgccaaacagagtgatgccctccacccctgggcctgccctggtctcaatccagagatctctttactcagagcacctgcccagcagtcagcaaaaacgtcggagctagaaagccccatggagtcactaagacccacacacacaggactgccatcagcagccccactctgggcagcaaacatttcatcaggagcccgaagttgccaactggctgcccaggtccagcaggccctgtctttgtcaaacccacagttgtggtcaagagcacctcttcctcccctctgttttcttgatttacctgggccctcgccaaacaaagtgcacatccttggtactctgcagcaacaaatggtggattacgcaaaccaccgtcagacttgccaagggcccctggctgaggatgacacccacctaggagagctacagcagacaatgggtcgcagctgcaggggagacaccagccaggagtgagcccaggtcagtgtcagggtctccccagcctaggagtgcccacagctctgccccacacctcccaggctctaaccctatgcctaggcacctgtgcaatgcaattacctcctatccttaaagagacggcagcttctctgcacctctgtgaagcagagggtttcaggggggtgattcgcaggggagcaccctgggggtttcttatgactcgaattgcttggcccacccccgattcatcaggtctgggtgagccagagaatgtacatttttaacaagtttgggaaccactacggtaggttatgagcctgctctggaacttcactgcctgagttagacgagttatctcacctcccagagcctcatgtcctctcctgccccgggcagctcccagtggtgcccactgcccaggctcctgtgtggctcaggcgcaattttgcccaccaaatcctcccagaagcacatcatgagtgccccagggcgttaattaatgtggtgcagcccctcaaataaccctgaggagaaatgaaaaagcaacatatattttcctttaaaatggaataaaatcattccagtttctggggttgccaagtaatgagagggaaaccaaagaggacaggcgtcagattgcagatcagtcctggctgtgggttggttgtcaccttggattggaacatactcgcccccagctctgagcctgtactcagtgactgcaatactgtggagccctgtagcccggtgaaaagagatgaaaaggccttcggttatttttcagttaacttaaagagcaagatgtacttggggtgaccagagctttctggttttctgttttccctgcaccatcctgcataaagggatctgtgatttaatgacagtgggggcagggaggtcaacccgttgccctgccgtaacagagaggaagatagggtccagcatcaggcttggatttcattacaagttatcacccctgggaaagtgtcctcatctgcaaaatggggacatgattgttgggaggaaagatgtgatgacgtgggcgatgcatgtggagtgcttactccagtgccaggcgccaggcactgaccagagatgaagcatcccagcccagcaggcggcatggctccacggcacgtgagctggcctgcacttccctcactgactggcggtgtggacagcacacagaaggggaaagagattcagatgaggactcaggtgtctctgtgactggccatgtggacatggtgccacttgctcagctgcagaaggcagaggcaagagggtgcttggtggggaggtagagggaggatgaaggctgtgtgtgtggaatttgaggggactgtgggacatccagaccaagatagctaacccagagatggcctgaagctccaggcggagagatccagggctgggaagtcagctacgcactcagggtgccgggagccactgggcagaagggctccccatgaggcagcttcgtagtgcggggagagggcaggtgccccacggagcctcgctgacctacactgccggctctggcccggctacagttcaaacccgagaaggcaccccagagcctgggacactgggcagcagaaatccttccctagaaaagcagtcagggccaggcgcagtggctcacacctgaaatctcagcactctgggaggcctaagcaggcagatcatctaaggttgggagttcaagatcagcctggccaacatggagaaaacccgtctctactaaaaatacaaaattagctgggcgtggtggtgcctgcctgtaatcccagctactcgggaggctgaggcaggagaatcactggaacctgggagatggaggttgcggtgaactgagattgcgccattgcactccagcctgggcaacaagagcgaaactccgcctctaaataaataaataaataaaaagcggtcagagggttaatgaaagaacgcaatagcctggcagctgttttcttatcatcagtgacgaagtcccctcaggcaaatccagagcaggctggccttttggagaaatctctgctactctgcgtactcccgtggtttccgtctcttgtgcccggatgctcttccgtgacactaaacagcaagcactgcccctcaggtgtgaagcgggcctcccagcctcccagacaccggcgctcagttgctcctggctcagagcctctcagacctgactgcacacacatctccagggacccgctgagcaatggattctgacacagcgggtcccagtgggcccgagactcagcatttctagcaggttcccaggggaccccactttgagcagctagagagtctctgcgagtctgcccacagttcagaatctgccactgggggtacacagccagtgccacagtctgggaccccttgttgacagctctaagaatcaacaaacagatcattcctaaaaatgcaatcttttaccctctgcagagaatcccagccagcctctaatgcatactggtgagattctaaattgtgtggattaacagacctcaaagacccccatatgagctattgtggctgtaaatggaggcgtagctccctccagccatgtgcttctggctcactgagcattcctggggaaggggaacacagtgcccggcaggaccctccccggagtcaccactgcctcgaactccacgcgaggtaggcagaaccagtccccgctcattttcactttaaaataggccttgtgaggacatttttgcctgttttgtggaactgcagttcataccagcttttatcaaacaccccagccttgcttattcgaaactcaggtgcacacggaagtgtacaaggggagatggacccgcagttggccacccaacagaaacccacctggagcaccttgcacttaacaagcatcccaagaggcagatgaaccgaaacacacagcacacagtggaccggggtgaaacctccagacactgtatatttggttagtgcagagttaatcctcagtagacaggcatagaccctggcccaggagaacttgggtgcaggtgcagggggtgccggtgcctatcctgggggctgcacagggctgcatctccaccagggctcgcgccccaccctggtttgtctgtggacccccagctggtgacagtggaaggagtggacatggtgggaagaggatcagcccagaccgctctcttttccttttaatattctgggttttgcccaaacctcttttagacatcacgtgcattcaacatgatgctggtgcgctaataatataaaaatgcatacttgtatgattctgggatggatttttttcaagcatttaggggtaatgcagagtaggtgcttgttttccatggcaatttttctgactcgcctggaaaacagcagacccacccagggctgattatccaacctctgcttcaggctctgcaggtgccttcattagctgccctcaaaccacacccattgctgcccaaggttggcactttgggaccggatctgctcacctgttcttgtgggttatatgtgtagtgacagtggcagcaagcagaggtgagacacttgtgtggggggctgacctcaccctcatgaggtcagccctgcagccagggatggcaaggcccaccgcctcccgtttgacccccctctagtcttagcataccttctgtcttgcccgggggcagaggcactgaattgtggacaaaaaagaccaagtaagctagatgcttgttcttctttcaattgatacataataattgcacatgtttatggggtacagagtgaaatttccatacatgtatacaaagtgtcatgatctgatcagggtaattatgatatccatgacctcaaacgtttatcacttctttgtgttgggaacactgcaaatcctctcttgtagctgtgagaaatatacaatgcattattgtccgctgtagtcaccctgcagcgtgccagagctcagaacaactcctcctgcccggctggacttttgtatttgttaaccagcccctccttccccacctctgttctgctccacttctatgagatccactcctttggcttccacacgagccgcgcgttgcttttatgaaacagctgtgcttggggcagatccatttccttttttgccacaagcaccttccctcgcctgtcggccacggagctgtgactctgaaaattctggcacacccttgcctttatctgtggtttgagggtctttgctcctctcccttctgctgaaaaggcagctccattccttattgccgagctccgagcgcagggaagaggcccattgtcaggaagtgagctgctgccctttggtggcctgggtggcctgtgggcaagtctgaatccccatgtcctcctgctccttgggcaatgatctagtgactgtgattctcctgaccagtcttgtgagaagtgtctccctgcagatgctctagtggccctgggaactttggaacgtgagggggcttgtggggtctggctgattgggtgctggctttcagcttcagtcctgacacgagaggctgagctctggagaaatgtcagggtccaccatcccacccatcttgcccccacctcctcggctgcgcacacgtgctcagagcaagcatttctctcaccaactcagggatccctgcacaccagggagcacccagcctacacctgcagcctggcacagttggggaccgtttagttggtgccagctggaggtgtttggagggaaccatccggtgatcaggatagaggcacagctggccgagggcaggtgggcgcctgtgggtgcaggaagatgtcacatctgcaggcattgtttggggacgtcattgtgtaaccagccctgcagggctgcagaggcatcccacaagtctgtgtgctctctaggctgcgtttattgccccactctagaccacaggcctgggcatatttgtgtccccatccccaaccctgtcacctgaagcagcctgcgagccccgacaggaagggacaagaagaggcgaagatgacaaacattcacagacagcccacggctgttcttttgctctgacagtgtatcttaagctcccttgagcgccttactgaacagatagatcagcttcttttcaatctcttgtttgctcttataaaggaaattaggtcatgctggaaactatgccatgatgcccctatgctcactcacctgatgaagtgtgggaggctaccccccagcaaacagaaatgggcacacaatctgaagcctccttatcacactggagacttccagagcaacttcagtaaggtctgtgagggggaacgctctgttgtttgacatgggcttgtggctttcagctaggggcacgcacttctccaccagctctttttttatttttatttattttttattttttttttgagatggagtttcgctcttgttgcccagcatggagtgcaatggcgtggtctcgactcactgcaacctccgcctcccgggttccagcgattctcttgcctcagcctccccagtagctgggattacaggcacctgccaccaggcccagctaatttttgtacttttagtagagttggggtttcaccatgttggccagggtggtctcaaactcctcttaggtgatcctcccgcctcggcctcccaaagtgctgggattataggcatgagccaccgtgcctgggcagctctttccctaataagaacactggttctgaggccaagtaagaggctaaattaagaaagcaaagatttatcataagtttgaggcccacgaggaaaaaagcctccattcatcatccagaaacacaaggaaacatcatttgcccctcagtggacaggtgatgtttcttacataccctatgacatagctgccctggtccctcccaagcccaatgtttcattggccaagcttccaatttgctttacaaggtgtgaggacagagaagcatccagcccattctcctgtggccctgctccatttagagcagacacgagtggatagctcagctggtcactagctcctgggctgcccccactcacagaacaagagtgtgcgtttctcctgagaacttcctactaaagaaaacagccagcccaggcatggattacaggctcacacctgtaatcccagcactttgggaggccaaggcaggtggatcacttgaggtcaggagttcaagaccagcctggccaacgtgcatttttctctataaaaaatacaaaaagtaggtgtggtggcacacacctgtactcccagcatctcaggaggctgaggtgggaggatcacttgagcccaggaggcagaggttgcagtgagccaagatcgtgccactgcactccagcctgggtgacagagtgagaccttgtctcaaacaaaacagaaaaacagtccaactaggaagcttgcttctcccggaagccttgctgcatgggctgaccaggcacagtgctgggccattccactgggctgggccaggctggggaggtaccttgatttggggatggcagctggccttgtccttgactcaggggctgcttttctgtagaccaagtgcacttcacggatttctccagaactggtagagacaaaagtgagagagtgggagatgcatttgaagcatgttggctttattatttgcaaaactgaagtctggcccaaaagaaggttgatcttcttttaggaggtctggaacaggacgtggtctcttctgtggtggaatgtttttgttttggctgaatggttgcgtcttagtgatttgactgagagcaaaatcagcttccattttatccccgctaagtcacactttttccatagaaggggagttgtgggaagcatagctttaagggaaggcaaagcacaccttgctctgaaactctttggtcacaaccatgtaaaaacatgtctgaggaaaaatcctaggcagaaatacagcaaaagtccacttagccaaggaggccatgggtagttcttttcctcctttcttgtgttcttatttttccagatttttatttttattttatttttattttatttttttttgagacaaagtttcacgtttgttgcccaggctagagtgcagtggtgtgatctcggctcactgcaacctccacctcccgggttcaagcgattctcctacctcagcctcctaagtagctgggattacaggcatgcgccatcatgcctggctaattttttgtattcagtagagatgcggtttcaccaggttggccaggctagtcttgaactcctgacctcaagtgatccacccaccttggcctcccaaagtgctgggattataggcatgagctaccgcgcccggccccttttctagattttttttttttttttttgagacggaatcgcactgtgtcacccaggctggagtgcagtggcgcaatctcagctcactgcaagctccgcctcctgggttcacgccattctcctgcctcagcctcccgagtagctgggactacaggcgcctgccaccacgcccggctaattttttgtatttttagtagagacggggtttccctgtgttagccaggatgatcttgatctcctgacctcgtgatccgccacctcttgtccttctaacaagaagaactcatacccatactacgtaaagatagctatcgcatacacttttatcaccagcctccttcccacaacaatatttatatgtataaatcaagaagctattatttcaaactgatgctgaacaacaatcccaaagtgctgggattacaggcgtgagccaccatgcctggcccccttttccagatttttaatagtgagcatatattacttttatgactggaaaaagtattaacacattcctactctatgtaattgaaggaattagtcaagtattgtatcaccctaatagtactttcatgtacacactctatgttgcttatttttatggatttcatatactttgtctccacgcataggaaaattgagttggtgaggcttgcaaaactccccaacccacactgtttagttttagcagacttatcacatgagtgttttcatttaaagaacaataaccagccgggcgcggtggctcatgcctgtaatcccagcactttgggaggccgaggcgggcagatcacaaggtcaggagatcgagcccatcctggctaacatggtgaaaccccgtctctactaaaaatacaaaaaaattagccaggtgtggtggtgggtgcctgtagtcccagttacttgggaggctgagacaggagaatggcgtcaaccagggaggcagagcttgcagtgagccgagatcacgccactgcactgtagcctgggcaacagagcaagactccgtctcaccaaaaaaaaaaaaaaagaacaataacgatgactctttagggttcattaaacagtctaagaaatacaaatatttagctcccctcagccatcactgcctcaggcccattcatgatcatgaatccagatccatgagctctgtggcagcgtctttgaaggtggagcttctctggatcatttgagggactctattttccttgcaggtgtgggagccacttcaggagcttctgccaacttccctggcacctcgggcagcagcaccctgtctcccttccagcacgcccacaaaggtgaggagggtgctcaggtatcgatcacctggagttaggtggtactcggatgaaagctcagaagaggagaggaaatgatcatgagtgatgattatggtgcgcttccccacctggcctcacctccctaatgtaattgaatgacatgttgccccccgtgcaggaagtcattatatctgcaatcagagttgatccctctatgggtgtcctgggaccgctgggaggtgctggtggtgaaggcgggggcatagcggcaggtggacagcacaggcagctgcaagcccggccaggaggagagaccaggcgtcctgggctttggtttggccgggagttaacagcaattctatcactggttttcatataaacatgctgaccatagcactttaatattaacttgcagaatgtacatttcattctccctaaccagggaagaagggattgaggaggaccccaaagtttaatatgtctctcagagtcagccctccagctggcttggcctttctctctcactggtttagtgccagcccattattgaagcatgtttcgggcccaggtctcagcgagccgtgaggtaccctccagagccctcagagcacccagctcgtcagcttcatctctgggcctcccacgcgctaacgcagagcaaaaggcaggactgctgggcgaggatatatgaatctcatttgcacaggccccggggggagtagctcaaaacacggagaatattaaaacacttatgtcatccagacctggcatgctaacgctattacaggtattccccagatgatgctgggaggctggttttcctgcagatgcacccacaggggaggctcagcgcccacatgcggggttctcagctctggcactacctcccccgagatgatttgggagcttcagatgctggtctcctgtctatttgggtggtggcaaatctggatcttagttcaagacaatcagagtcctgtttggttattttagagaatgagaatgagcttcagggcattttatgcatccagggtcgacattaacctgggaactgagcaaaatcccccggggtgactgagggactgcctggtggaggcggcagtgcaggtggaataggtggcccagccgaggcaccccctgtgccctggggctcttacaatgacacttaggttgaaattgcatgaggtgcaagatggagccaaacctggaatccagagctgactttcgcatcctgacttttgtttggaaatgcccaaacttgaattgtgctgccttccagccactcttgttcactggcctttcttcctctccacaccaaaccctgccctcaggttgccaaagcagtagaagcaagagcaaactccctaggaacaatcaggtgaccccagagaagtctggagaggccagtctgagggcagcgagcagggctgtgggcagtcctggtctggcagccaaaaccagcgcggaggatttggttctcagtctaagcaagcacctcagatttcagggttccctgaaagcatcccaggggcagggccattgcttccaggggccggagtcctggagggaagaccagcagggatcctgagctctgggtcattcatgccttctctccacccacagaactctcaggccaaggacacctggccactgccctgatcattgcaatgtccaccatcttcatcatggccatcgccatcgtcctcatcatcatgttctacatcctgaagacaaagccctctgccccaggtgacggcccccatgcgccggtgccctgcttcctggactctccgtcaactccccctgtcggagagcctggctgctcactccctcctctctccccagcctgttgcaccagccacccggggaagagcgtggaggcccaagtgagcaaggacgaggagaagaaagaggccccaggtctgtgaaccagggcttccacacaccatgtgcacggtgcccatctctgggtggagggcgttcccagaagcagcctcctcgctgcttctgctctcacatgctgaaccatactgtgcttaccgtggggtggtgccacacagacaccgggcagctctgcccaacaggaagagcagggttgggctgagcgcagagccatgagccaattctaactcctatctccccaacctccccatttccctgcagacaacgtggtgatgttctccgagaaggatgaatttgagaagctgacagcaactccagcaaagcccaccaagaggtatgtggaagcccccagcaccaagctgaagctggggtcctgtggatcctgagcagggaggggaaccagggtgcagccgagtgaactgacaggctagcctgggacactatggggacgttcggcgacagacagtccccaccacctctttgctgactggcaggggtcaggtggtgtgaggagcctgtggaaacagctgcctgctgctctcgggtcaggcccctgtccctgcatcctgccaaattccctgggccttcctccttaacatccgaattcctcatgccccttctccagactgggagggcagaacataaagccaaggatgcatgcctgttgcggccaacacaccagtaccacccgtgccggtgccagtactgctgccaccgtaatgctggtaacaaccgtggtgatgacggctaacagcatttggtgcctactgcccaccaagtgctgggctagggctgtgaacacatcctccctccacagcccaggagcaaggtgcttgtatcatccctgtttataggataccacactgaggtatggaagttgtcactcgcccaaggtcacacactagtgaacagcagggctggggtccgagtccaggctcccaaggagccacatggtgtaaagaggcctctggaggaggagatttggcaggtgaagcctttcccgcgtttaccacacatgaaggtgtggaaccagcccctgctctaaaatcgagggtagagggaagtcaatattttattcatccagtgggatggtcatttggacttggtcctgcgtagcttccaaaaatcaaccccacagcatcagctcccagccaggcaatgtgctcggacccccctgccaggcctctgcccgacagccactgcaggctgcgcctggaaggacacccccgcaacagtgcctcccttggcagatggggcacagaggccaccagaaggtcaccaaactggttacaggaagagcagaggttaagccctcctctcctgcccccaccccatgatcttcctatgattcaccttgcaaagccattccaatcgatccagcatctgtgtggagatcctgtgtgccagatccaagctgctgctcccaggaccaagggcaggacctggtcaccctgcatggaactcttaaatagggcctccctagagactgaatttgctcctcagcctccagcccagccttatctcattctgtctcagcctctcccttctgatattcaggcttttcttattcccagaaatcaaaaaggcagagacgtgccccatgacttgagttgcagttgaagacagggaaaatttggaggccctattaggaaaaaatatatactgctttcatacacgaatattaaatacaaattgaaccctgacacttgtacgttaaaagacagcaaggcactgagcttttgtccctgctgtttgtccttaggtctcagagacaggacctggggtgccacctcacctgctccacctcaccttctctcgagtggggacagggatgggtcctaccacctccttgtgaggccctgaagcctgatgaggaagtgggtcccactggggcttcatgatggttctcattgtctttgtattaccctgtctctagggttgtgtttgcatatgggcttcactgctgtaacctagttactaacaaatataatcctttttttaagaaaaaaaggtcttcagccaaaccacaggaagcaagcaggatgcctctaaaaaagaatattgtttttcatatacttggaatggttttaagagagtttaagctccaacccacatgtgcctagggcagaccctgggttctttgtgggctgtgagccacagggcggcatgaacctgggcttggtgggtccgaccgcccacccagctcacccgctggggcttgctgtgccaccccctgcaatgcacacaggtcagccaggtcacccccctagtcaagagggggctttccaggcacaaggctccattcagctcccttttcaatgactccagagagccagcatggattcagcgccagctgcatcaatctgtttgcttaacatgaagacaccagttgaacttggtgcttactgggattaaatacagagatctaggacatattcaatgaaccttcacggagcatccattgtgtgtcaggtagcagggaaggagaggcccgtggatgcctcccacacgcagtggcagccccagccccttagacgcctgcaggtcacccaccacggacttgtttgtttggaaagaagcaggaagccaccggtgtatgtctcgtctcatgtcccctggtcccgtgcccacaaggtgcccagtaaacacctgaaaaacaagtcattgccccccactgtccacagctgggcaatggacaagttcaccacaggagaacttgtcagggctgcagcccccccaggcactgctaatgaccatcgctcttgtttttgcagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccggggtgaggctcctgcaggtgccatgatgagctgtgagatgtggctccctcacagccgcaagactaaaactttcttattgaatcagctctcctgcaagacggggtgtttctcccagaagtccaagataggagacctggacagtgacaagttcacagcaagatagtcaaaagggaaaaaaaccctttcgtttttgagttttgttttttttttttggagatgagagtcttgctctgtcacccagcctggagtgcagtggtgcgatctcggctcactacaacctccgcctcctgggttcaagcaattctcctgtctcagcctcccaagtagctaggactacaggtgcacgctgccacacccagctaattttttttatattttagtagagacgaggtttcactgtgttgcccaggctgctctcaaactcctgagttcaggcaatccacccgcctcggccttccaaagcactaggattacaggtgtgagctaccacgcccagccactttgtttttattatatagcttcatacacaaaaacgaaaaataataagcaaggagaaaaaaggtaaaatcacttggaatgccagagggcagaaaaagacccttgtaaatatacggggttttatctaaccagacaattttctagacacacacacacacaacgtttttcttctatgcatttttaaaaatataaaaacaggttcacatgtagaaactgtccccagggttttatcacctaccgccctgtaatgtgctgtggccaggagcagggcaggggtgagggcaaaggtggccagagccctcttgggctccctgtagacctggcctgtggtcgtccctctagcctgtgcccctggctgcaggccccagccgcaggacagctgtgttgctaggcaacatcactgatggcaaaaatgcccagttgggatcctggctccagcctggtcctgataggatgccaagctctgcctgccccgagttcagtgacctctgtaatggggctgccacttgcagagaccctggaagcctgtggggttgttacaagggagataggtggccatggccccgggactcttcagccagggccactgagcagctgtgcaccgtgggcctggtctcctggcaccagccacgtgatccgggatgggagccccgcacggctctgctgcagcacagatgtcctgagggcaagtgggggtccccatggtcatcttttcaaacagactgatgccaggggtgtccccaagtatcttacgagtctgaccacccagctgagcctaagacgcacccgtggtagaccccaaaaatgtttgaataggaaaacctgaagaaggccctcctccctgtgtgtcagggctgggctgctgacacgggggctgtgtgcagcgtctctggtgttgggcgtagctgctgcctgcccctgctgacatggaggatttgcctcctttctactgttgcccctttctggagatgaaaattctcgactctttttcacagattcaaagccggaggaaaaagatcctcgatgtgtatgccaacgtgtgtggagtcgtggaaggtaagctgaaaaaaaagcctgggagaggtggtgcccaccccaccgacatgaagggctgggcccggagccctgaggctcctgtgaggggaactgagggaagccgcccatccagttgccgcactttggtcagaatggccgctggaaactatttcaggtgtggggaaacagaatcttgttcccagatatcggaaggcatctcccagtgcttccatgggccttcccctcatggggcgggagacagcctggtgcaggcacccactgtagggaaacgcagggtcggtgagcagcagccacggagcctcagacctcccgtgtccccagagaccgtgtccacactggcatcatcatctgggaaacgtgatcagtcatttatcctagacttagctgccctctccctgccctcgagcatccccgatgtctgatagccctgggagcctccagcctcccctcccagcggccttctgagctaagtcaggctgtctccccataacctgggcttgagtgtgggcaggttaagaggcaacaggataggaccgtcagtgctgcaatctgaaatcataatcctcagcttccagttcctgcaaaatccactttctaaattaccttcttattaaccccaaagataaatccctcatggctgaggtcaggggttttcctgctgctggactcgctggcctccctccgtggactccttgatctggccgggcagcgggagtggagcctggtgcatgctgggcagctcaccaatgcccccattacccctcctcccacccccacaccccaccgtaggccaaatgcagccccctgtgccctggcaggctttctgatccagtgctttgttggccagaaataactatactgtgggtgagttccagggccaagaattcttggctgccgctgaaatgtggcatctctccataaacgcatgccccaggtcagcctgcctgatctcacctggcatggcctggggctgtcagctgcccaggggaggatggtctaggactcaccttccatccaccaggaagctcttctctgttccaaaaaatgttgagttcacacccctgggacagaggttttcaaacctcagccagggctgagaacctgtgctccatgcccagctctgatgaacattagagtcacctgcaggtcttaacaccctctctgcccatccagcccacccaatctgcccaaacaccctgatgtaattagtcaggggtgaatcccaggcatctgtgtctctttgttttttgttttgttttgtctttaattaaactttttattttgagatacttcttaccatgcagtggtaagagataatacagagagatcctacatgccctttacccagtttctcctaacgataacatcttgcaaaactatacacagaagtcacaaccaggacactgatattgacacagtgatatcgactcagctcccatacaaaaactcctcctgttgccttttatagccacagccaatttccacccaccccaccctcacctaggcccctggaaaccagtaatctgttctccattcctataattttgtcatttcaagagtgttataaaagtggaatcacaaggtatgtaaccgtggtgaatggcttttttcactcagcataattcactggaggtccatccaggttgttgcatgtatcaatagtccattcctctctcttgctgagtagtagtctgtggcataaatggaccagagttggtttaaccattcacttgttgaaggacatcagggttatttccacttaacggctattatgaataaaggtgctataaatatttgtgtataggtttttgtgtggacatcagtcgtgatttatctgggataaagacccaggagtacatttgttgggttgtatgatagttgcatggttgattattttaaaaaactgccaaaccgttttctaaagttattgtaccattttacattcctactagcagtgtgggaacggtctagtttctccatatgcttgccagcatttggtggtgttactatgttttgttttagctattctgagaagtgtgttatgatatcttattgtggtctcaatttgcatgttcctattgtttaaatatgttttcttgtgtttttttcatctgtgtgtcctcttcagtaaaatgaatgtttcttcatgtcttttgcccatttttcaatggtatcgtatgatttttttgctgttgagttttgagggtttttaaaaatatattctagacactagtcctatgatggatatgtggttttataaatgttttctccattctatagtttagcttatcttttcagtctcttaacagggtctttcatagaatgatgttttaaatttttatgagtcaaatttatgaaactaattataaagttttctttttatggatgatgcttttgtgtcaaatctaagatctctcttgcctagtcctagatcccagagatttgctcccacaattttttctagaagttttatagcttaatgttttacattctaagtccacatagtttttatgttttacatttaagttcacatagttttatattttgcatttaagtttgagttgatttttatagaagatatgaaacttgggtcaaagttcatttttttgtctatggatgtccaattgctccagcaccatttttttgaaaaattatctttcctccattgaattgcttttcaaactttgtcaaaaatcagtttggcatatttgtataggtctattttctggggttgctgttctgttgcatttatctacatgtctgtccctctgataataccacaaggtcttgattcttgtataaattatgtaataacatataagtcctgaaatcaaatggactgctcccattttcctttatttttttttcaaaaatcttttagctattctagttcctttgcctttccatataagttttataataatcttccctatatgtacaaaatgccttgctgggattttaatgagttgcaacaaaactgtatatcaatctgggaagatttgacatctttattatgtcgagtcttctgagccatgggcatggtatatctcttcatttatttagcacaactttaattttttttcatctgcattgtgtagcttccgaaatacaagttctgtgcatattttgttagatttacaccatatcatttattttttgagccactgtaaacgacaatttaaattcagtagccatacattcattgttagttatatagaaatacaattgatttttgtatgtttatcctgtatcctgtgaccttgctgaattcacttataagatctgggagttttcttgtagatgccttgggattttctacatagataatcacatctgcaaatgggaccgttttatttcttcctttccaatctgtgtaccgtttctttccttttctcattttattgcactggctataccttccagcactacagtgaatataaatgatgaagcagaagcagaaatccttgccttatttctgatcttaaaagcattccatttttcaccattaagtataatattagctctaggctttttataaattgttgacattaattttttgagtggattacaataatttttaaatattgaaccagccttgcctccctggaataagccatacctgatgtggtacaattcttttttatggttgcattctatttgctaatattttgttaaggattttgcatttatattcatgagagatcttggtctttggtttgtggtttgttttttgtctttgtctggttttggtatccagtttatactaccctcatagaataagttaggaagtgtttcttccttttctatgtctagaaaagatcgtgtagaattgctattctttcttaaacattttgtagaattcttcagtgaaatcgtgaggacctagagatttcttttggggaggtttttttgttttgttttgttttgtttttgagatggagtctcgctatgtcacccaggctggagtgcagtggcacaatcctcgctcactgcaacctctgcctctccagttcaagtgattctcttgcctcagcctcccaagtagctgggattataggcacatgccaccatggcccagctaattttttttttttttttttgagacggagtctcactctgtcccaggctggcaacctccacctcccaggtttaagcgattctcctttctcagcctcctgggtagctgggattacatgtgcatgccaccatgcccagctaatttttgtatttttagtagatatggggtttcaccatgttggccaggctggtcttgaactcctgaccttgtggtccacctgctttggcctcccaaagtgctgggattacaggcttgagccaccatgcccagccctaatttttgtattttagtagaaatgaggtttcaccatcttggccagactggtcttgaactcctgacctcaagcaatatacccacctcggcctcccaaagtgctgggattacaggcgtgagccaccgcgtttggctagatatttttacagttacaaattcagcttccttaatagttataagtctgttcaaatgatctattttatattgggtaagttgtgatagtttatgttttttgaggaattgtttattttcatctaagttatcaaatttatatgtgtagagttaaagttgcaagttttatcttattatctgtttgatatctatggtgtgtatagtgatatctcctgcttcattcttgatattggtaatttgtgtcttctctattttttccttgtcagttatattgatcttttcaaataactgtctcttttcatattgatctcttttactttatagttttcaatttcattgattactgctcttatttctaaattacttatttccttctatgtacatttggtttattttgttaatctttttctaagtgcttgaaatgggagcttagattgttaacttgagttttcctcctttgtatgtatctgtcctataaatttcactctcagtactactttagctgtgtctcacaaatattgacatcttgtatttttattttcattcatttttaaattgtctttgagacttcctctttgacctgtggattatttagaagactgttgtctggttttcaagtgtgtgaagatttttctgttatatatttatattctgattctattgtggtaggggaatatcctttgtataatttcaattcttttaatttgttgaggtttaaggccaataattatgaacaatgtgtattctgctgttgttgaatggagtgttctataaatgttgattagatcgtgttggttgatgatgttggtaagttctatattcttgattttttttctaattgttctatcatttactgagggaggaatgttaaagtcttcaactataattgtggacttatctcttctttcaggtctatcagtttttgtttcacatattttggagctctgttgtttggtgcatattcatttaggattgctatgtcttcttggattgaccctttaatcattattaaatgtcactttctggtaattttttcctctgaagtctactttaactgatgttatagccactctgccttcttgttattgaagtttgcatgatatgtatttttccatcctttacttccaacgcctctctcattatattgaagtgagtttcttctaggcagcatataactgggaaaatttttaagtctactctaccaagctctaccttttagtttttttgttttggtttggtttgggttttttgtttttttttttttctttttttttggagtttccactcctgttgcccaggctggagtgcaatggcatgatcttggctcactgcaacctctgcctcccaggttcaagtggttctcctgcctcagcctcccaagtagttgggatcacaggcatgtgccaccacaccagctaattttgtatatttagtagaaacagggtttcaccgtgttgaccaggctggtctagaactcctgacctcagctaatccatctgccttggcctcccaaagtgctgggattacaggcatgagccaccaggcccagcctttagttggtatttaaaccatttacattaaatgtagtcattgttagggcttaagtctgctattttatattttgtttactgtttgttgtctctgtttttcatttctgtgtttttttattcctgctttactgtgggtcacttgaacatatttcagaattcgattttggtgttttttgagtgatacattttgattttatctctttccatagttattttagtagtttctctagacattgcattgacacatataacttatcagtctactggtgttattattattattatttttgacatggagttttactctgccacccaggttggagagcagtgacacgatctcggctcactgcaacctccgcctcccaggttcaagcgattctcctgcctcagcctcccgagtagctgggattacaggtgtgcactaccacgccaatgtgttttttgtgtttttagtagagacggggtttcaccatgttggccaggctagtcttgaactcctgacctcaggtgatctgcccaccttggcctcccgaagtgcttggattataggtgtgagccaccgtgcccagccttactggtgttattattttgccagtttgaatgaagtataaaaaccttacctttctctatgtccctttaccttctctgtttacagtagttgtaaatatttcctctacatatatttagaaccacataaattgcttcaactgcctaatgtaattcagaaaacttaaaaagagaaggaaagtctattgtatgtgcccatatttttgctcactatgttcttttctgatgtctcaagtttcattcttttactatttcctttctgtttatagaatttccttttgcttcttttaggataggtctgctggtgaaaaattcttaacttttctttggcttggaatgtcttgatattctcatgctttcctgaaggatattttcactcagctcactgcaacctggtatgcaactctgggttgaaagttcttttctttcagtacttggaaatactgtgctacttctctctggtctccaggtttctgattataagtctactgtcattctaattcttttccctctctaggtcaggcgttgtttttctttggctgtttctaagactttgtctttagttttcagaagttcatttatgatgtatcttgacatgaatatatttgggtttatcctgtttgggatttgcttatcttcttgaatctgtagacttacgtctctttacaaatttggagagttctaaaccatcatttatttgagtatttatttagtcccactctcttctcctctccttctgaaacttcttgacacaaatgttagctcttctgttataactccacagttccctaaggctctgtgtttttcagtttattttctctgattgagtaatttccacttctagtttccattatccatctcactgattctttcctctgtcttactctgtcattgagcacatctactgagctttttattgtggttattgtacttttgtagttctaatattttcatttcttttttacattttctattatttttcctgaggatttctatttttgcatttaagcatgttcataattgcttgttgaagcacttttattatgaattctttaaaacctttttcagattatctaacatctgtcatctcagtgttagcatctattgattttctttttttactcatttgacatcttcttggttcttggtatgatgagtgaattcactttgagacctgtgtagttttatgtcctgatatgaaactctgggtcttatttaagccttctattttagctggctccttttgatagctctgtggcaggagaatgagggtgctgtcttgctactgttgggtgaaggtagacatccaaattccccactcaaccttcactaacactcaagggggattcctttttactgctacttggggtttgggagtatggctactgacatggtcaccacgggggcagaggagtttttaccagctggttgatgagaaagccccagctccctacatggcctttcctgacaccacctggcacagtgttacagcctggtgagggtggaattctaggctccccactcagcctttgctaccctggatagagtggggacacagtttttctgtgatgtttggctggaatagagcaattattgtctaaatgttttatgcttgctaggctgctcttttcctagtgctctgactagagacagaagacttttgttggggctgtttttgtctgtggttgctattatttccagatttttggacttttctgccccatgtctggaatttatgaggcaaaagaaaacccagggaacttaccaccatcaccatcctaaggtatcgaggtccctagttggtctgtcttcttttctccacttttcagacttcttgtatttgttttacacagaatgtccagggcttttagctgtacttagtgggaggattagggaaaattatatctactcttatcttccagaaacagcaatatcaagtttttaaatgctcctaggtgagtctaatgtacagtgaagcccaagaaccatcagaccactgagttggcagtgacttggttcagataaccccaatctggggctatcattgagagcagccatcacaaagttgactactgttccctaaagagacatgacactgtccctttgaacccctcctcagcccagccccatgggagacagggttacccaactaaggataacttgtcttgaagtctttgagaactgctaaaaatggtcatgagggaattattatcattgtcaatatagcagtcattttcctagtggggaaggggctattaccggggtcagggtacatgcacagccctctcttgtggctggcagcgttctaggtgtcgtttgccttaagttatgcatttgttttaggtggctttctgcatgttttataattttaaaaaaatttttttcaaataatttttatttcatttaaataatttttcagtgttgaccttctattgactgtgacttgcaacatctaactgtggccattggtgtctgtaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggagccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttgatgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggttgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacacattaataagatttatagactaccgtaatgtgagctctctttgtatttggggtggtgggtcggggggtgagtggggaaggttctgattgctctgttcctggttattgccctatgtatgatgagactgtaggattgcaaccagctataaacaaagtgcctaaaatgttatggcctgggacattcactaggcagaagcaaacattacaaagagatcatgtaaaaaccacctggagcattgctttccaagttgccatcattagctcataaggcattgtatcacttatctatttctgtgtaacaaactgtcttgtcttaaaattcaatggcttaaagcaacagtcatttattatcatagctcgggggttagtagggggtcagtcagctgacttaggttgggctcagttgaatgtgggtcaactggggcctctgtctgttggaataccttaactggggcagctctactccatcatctctgtcaacctagatagataacagagagaggctctctaaaagaaagaaaatgatatgtattggggaatagggcattgcaatgggaatacatgtgccatagtaaactatgcgtgtttttgaagaggtaaaggaagacaatggttcttagaggaaaataaggaggattacataattattttgagacaattatccttggctacaaggataataagggtggtgccagtccagggttggacagggagttgctgggcagaggtccttgcaggagtctttgtgtgtgtttaagattgtcatggcctttgtgcaaggttttcgttttttcagtcttgtgatggctcttgttatcagtgatttatgcagggagaacccttctttcctggccttccatgactctatttgtcagttttgttttgttttttaagcacaagtgactcctttataattctgacaacttccacatttcccccatttgatcaagatctttatcagaaagcatccccagtgagtcatcccatattattccttcgtgccaggatagacctgtcctaggtggctggtctggtctcacattggagggatttgatggtgactaggagtcagtgtcaaaaccctttagccatgtttgaacaaatgggaagtttggagagagtggctctcaggctaggtctacttgaagtctactgttaaatttgattttgtctgttctgtaaacatttgctatcatcatctcaaaatgcagggccagtattattctgttagaaggtgtacttctactgagatttgacaagtaacaggaagtttaaaaaaggaaaatataaaggaaaattaaaatcaatagtaatatgagaatcccagtttgcatgatgattttgagccatgaatgtaggtttaaaggcaaccaaatgaataaatgaaataaccatgaggaattaggtgacccttcttttatccttgtggcctctttctttattttgtgaacatgggtctcaactttcccagaggaatttacctaggtacagcaatgtagtattagaaatagcacagacaaagatggctactagaagcatttcatgccagcctcttccacttagaacaaaaacagtgtgtagacagtcacactttgaatacattatccaagagagaacactggaattcaacagagaagtggcaggaaacaccaaaagcagggaaggagaagggagacaagcagcctgcctagccaggatcaactaggagctgggagtgacttcccaattcagggaaagggtgaataagagacttccagtggcccagatccccagcatgaactcatgtaatcctggccatgagagacccctcaaccctcccaaccactgaagctaacatagggagctgctgggagaccatgggatggaactgctccagagatggagtttgcactggatcccacacctttctgagacctaagcaactacagcaagacaccattttcaaacctagccttgggtagattgcatgctgtcctggggcccagaggcactgggactgaggtgttacagaa

SEQ ID NO: 217 - DNA, 1401 bp, Homo sapiens
atgtgcaataccaacatgtctgtacctactgatggtgctgtaaccacctcacagattccagcttcggaacaagagaccctggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattttcagccatcaacttctagtagcattatttatagctgccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctag

SEQ ID NO: 218 - DNA, 826 bp, Homo sapiens; identical to SEQ ID NO: 133

SEQ ID NO: 219 - protein, 239 aa, Artificial sequence
  Single strand DNA oligonucleotide
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 220 - DNA, 720 bp, Artificial sequence
  Single strand DNA oligonucleotide
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 221 - protein, 225 aa, Artificial sequence
  Single strand DNA oligonucleotide
MRSSKNVIKEFMRFKVRMEGTVNGHEFEIEGEGEGRPYEGHNTVKLKVTKGGPLPFAWDILSPQFQYGSKVYVKHPADIPDYKKLSFPEGFKWERVMNFEDGGVVTVTQDSSLQDGCFIYKVKFIGVNFPSDGPVMQKKTMGWEASTERLYPRDGVLKGEIHKALKLKDGGHYLVEFKSIYMAKKPVQLPGYYYVDSKLDITSHNEDYTIVEQYERTEGRHHLFL

SEQ ID NO: 222 - DNA, 678 bp, Artificial sequence
  Single strand DNA oligonucleotide
atgaggtcttccaagaatgttatcaaggagttcatgaggtttaaggttcgcatggaaggaacggtcaatgggcacgagtttgaaatagaaggcgaaggagaggggaggccatacgaaggccacaataccgtaaagcttaaggtaaccaaggggggacctttgccatttgcttgggatattttgtcaccacaatttcagtatggaagcaaggtatatgtcaagcaccctgccgacataccagactataaaaagctgtcatttcctgaaggatttaaatgggaaagggtcatgaactttgaagacggtggcgtcgttactgtaacccaggattccagtttgcaggatggctgtttcatctacaaggtcaagttcattggcgtgaactttccttccgatggacctgttatgcaaaagaagacaatgggctgggaagccagcactgagcgtttgtatcctcgtgatggcgtgttgaaaggagagattcataaggctctgaagctgaaagacggtggtcattacctagttgaattcaaaagtatttacatggcaaagaagcctgtgcagctaccagggtactactatgttgactccaaactggatataacaagccacaacgaagactatacaatcgttgagcagtatgaaagaaccgagggacgccaccatctgttcctttaa

What is claimed is:

1. A cell culture comprising naïve human pluripotent stem cells (PSC) and a culture medium comprising about 1-300 ng/ml of LIF, about 0.05-5 µM of BIRB796, about 0.1-5 µM of CHIR99021, about 0.1-50 µM of PD032590, about 0.5-25 µM of SP600125, about 0.1-25 µM of Y27632, about 0.2-10 µM of CGP77675, about 0.1-20 ng/ml of TGFβ1 and about 0.5-10 µM of IWR1, and
wherein the culture medium is capable of maintaining the human naïve PSC in a naïve state for at least 5 passages, and wherein
(i) when said naïve PSC is a female PSC, then said naïve female PSC has two unmethylated alleles of the promoter of the X-inactive specific transcript (XIST) gene; and
(ii) when said naïve PSC is a male PSC, then said naïve male PSC has an unmethylated allele of said promoter of said XIST gene, and said naïve state is characterized by: ability to maintain pluripotency the absence of DNA methyltransferase 1 (DNMT1) expression as determined by OCT4 expression in an immunostaining assay; and an expression level of transcription factor E3 (TFE3) in said naïve PSC is characterized by a nucleus to cytoplasm expression ratio which is equal to or higher than 1 as determined by an immunostaining assay.

* * * * *